United States Patent 11,098,302 (IDENTIFICATION OF POLYNUCLEOTIDES ASSOCIATED WITH A SAMPLE) - sequence listing, part 101

SEQ ID NO: 347438 - DNA, 590 bp, Homo sapiens
  misc_feature: GZ8MTXP01C03TR.15.86.H09.1.454.CMB.2.raw
  modified_base (288)..(288): a, c, t, g, unknown or other
  misc_feature (288)..(288): n is a, c, g, or t
  modified_base (341)..(341): a, c, t, g, unknown or other
  misc_feature (341)..(341): n is a, c, g, or t
  modified_base (394)..(394): a, c, t, g, unknown or other
  misc_feature (394)..(394): n is a, c, g, or t
  modified_base (484)..(484): a, c, t, g, unknown or other
  misc_feature (484)..(484): n is a, c, g, or t
  modified_base (511)..(511): a, c, t, g, unknown or other
  misc_feature (511)..(511): n is a, c, g, or t
  modified_base (520)..(520): a, c, t, g, unknown or other
  misc_feature (520)..(520): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtccctagagtctcctgtgtggcctctggattctacttcagtaanggctggatgagttggccgcaggctcgagggagggctggagtggtgacgtttanaaagtaaatgatggtagaacgaaatagactaggtcgaacgaccgtgaaagganacgttacaccatctacaaagagaataaatacaaaaacggtggtattaatttagactaaaatgaaacacgcccgtaaagggaaaacccggnggaaaccacgagtacccgtatattacncgtaaccanagtataacggaagttgacagtacggagttaaaaggcgactaatgtctttgattagtcgttcggggaaccg

SEQ ID NO: 347439 - DNA, 563 bp, Homo sapiens
  misc_feature: GZ8MTXP01APEKV.15.86.H09.1.454.CMB.2.raw
  modified_base (302)..(302): a, c, t, g, unknown or other
  misc_feature (302)..(302): n is a, c, g, or t
  modified_base (403)..(403): a, c, t, g, unknown or other
  misc_feature (403)..(403): n is a, c, g, or t
  modified_base (413)..(413): a, c, t, g, unknown or other
  misc_feature (413)..(413): n is a, c, g, or t
  modified_base (526)..(526): a, c, t, g, unknown or other
  misc_feature (526)..(526): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaactcccccagtatataatagaaagttaagagtgatggcagccacgacgaagggggacggacncccgatcgctcagtgggctccgagttcgtggggctcgaccgtctacctcccaccatcctacccacctccacgtctgacgatgagctgatatcatggagganagacgccaanacaagttgaagtcgggaccaaggggggtcgggtttggggtcgtcggggacggtagggacctaaggccgtgacccgtcgtaggcaacgccccgaggcccttcggccccctgccncttccgtcgtccccaaccgtcctcgcctaacgcgtcg

SEQ ID NO: 347440 - DNA, 628 bp, Homo sapiens
  misc_feature: GZ8MTXP01AHGDH.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccgagggaactcccccagtatataatagaaagttaagagtgatggcagccacgaccgaagggggacggactccccgatcgcttcagtgggctccagttcgtgggggctcgaccgctacctccaccatcctccaaccctccacgtctgacgatgaggctagagtatcactggtaggagagacgacccaacactaaagttgacgtacgggacccgaaagggggttcggggtttagggggtgttaccgggggcgggaacgggacccgaaggtcctcggtacccgtaccgttaacgggccaacggccccttaaggggcccttccggcccccttcgggttcccttaccgttccttccgttccccaaccccttcgtacccggttctaaccggaagtaaccg

SEQ ID NO: 347441 - DNA, 687 bp, Homo sapiens
  misc_feature: GZ8MTXP01EZT6H.15.86.H09.1.454.CMB.2.raw
  modified_base (303)..(303): a, c, t, g, unknown or other
  misc_feature (303)..(303): n is a, c, g, or t
  modified_base (423)..(423): a, c, t, g, unknown or other
  misc_feature (423)..(423): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaagggggacggacncccgatcgcttcagtggctccgagttcgtggggctgaccgctacctcccaccatcctacccaaccctccacgtctgacgagtgaggtctgagtatcagttggaggacgagacgacccaanaactagttgagtacgggaaccgtaaaggggggttcggggtttggggtcggtaccggggacggggaaccggaaccgtaaggtcccgtaccggtaccccggttaccggtaacgggtcccgaaccggtaccccggaaacggggtccccttccccgggtcccccccggttacggttacccttcccggtttccccgtttcccccgggttcccccccgtccccgtttccccggtaccggttacccgttaaacccgggttaacgtcccggg

SEQ ID NO: 347442 - DNA, 692 bp, Homo sapiens
  misc_feature: GZ8MTXP01BNL40.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacaccgaagggggacggatccccgatcgcttcatgggctcgaagttcgtggggctgaccgctacctccaccatctccaacctccagtctgacgatgaggctgagtatcacgtgtggagagacgccagacaagttgagtcgggacccaaagggggtacggggtttgggggtcggtttccgggggacggggaacgggggaacccgaaagggtccgttacgggaacccccgggttaccgttaacggggtcccgaacgggtaccccccgaaagggggtccccttcccggggacccccccccgttgggggttaccccgttaacccgtttccccgttaaccccgggtttacccccccctaacccccgtttccccgtacccgggttacccttaaccggggttaaccgtaacccggg

SEQ ID NO: 347443 - DNA, 635 bp, Homo sapiens
  misc_feature: GZ8MTXP01D4LKX.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacgaccgaagggggacggactccccgatcgcttcagtgggctcgagttcgtggggctcgaccgctacctccaccatctccaacctccagtctgacgatgaggctgagtatcactggaggacgagacgaccaacaactaaagttgaatcgggaacccaaagggggtcgggggtttggggtcggttccggggacgggacggggaccaaaggcgtcggacccgttccgtagggtccgaacgccccgaaagggtcccttccggcccccccgttcgggttacccttaccgttcccgttccggtttccccccaaccccgtttcccgtccgggacccttaaccgggttaacgaacccggg

SEQ ID NO: 347444 - DNA, 680 bp, Homo sapiens
  misc_feature: GZ8MTXP01CNJVE.15.86.H09.1.454.CMB.2.raw
  modified_base (337)..(337): a, c, t, g, unknown or other
  misc_feature (337)..(337): n is a, c, g, or t
  modified_base (403)..(403): a, c, t, g, unknown or other
  misc_feature (403)..(403): n is a, c, g, or t
  modified_base (417)..(417): a, c, t, g, unknown or other
  misc_feature (417)..(417): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacacatcgaatggtatcaacagagaccagggaacgtcccccagtatataatagaaagttaagagtgatggacagaccaacgaaccgaagggggacggactccccgatcgctcagtgggctccgagttcgnggggctgaccgctacctccaccatcctaccaacctcagtcagacgagtgagctgagtatcactggnggagagagaccaanacaaagttgaatgggaaccctaaaggggggtaccgggtttgggggtacgttacggggacgggaacgggaacccgaaaggaccgttcgggaaaccccgttccgtaacgggtcccaaacgggaccccgaaaggggtccccttaccgggtaccccccccccgtggggtttccccaaccccgtttcccgtttccccgggttccccccccggtccccctttccccggttccggttaccccgtttaaaccgggttaacggtaaacccgg

SEQ ID NO: 347445 - DNA, 582 bp, Homo sapiens
  misc_feature: GZ8MTXP01D4MG9.15.86.H09.1.454.CMB.2.raw
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
  modified_base (327)..(327): a, c, t, g, unknown or other
  misc_feature (327)..(327): n is a, c, g, or t
  modified_base (450)..(450): a, c, t, g, unknown or other
  misc_feature (450)..(450): n is a, c, g, or t
  modified_base (453)..(453): a, c, t, g, unknown or other
  misc_feature (453)..(453): n is a, c, g, or t
  modified_base (488)..(488): a, c, t, g, unknown or other
  misc_feature (488)..(488): n is a, c, g, or t
  modified_base (491)..(491): a, c, t, g, unknown or other
  misc_feature (491)..(491): n is a, c, g, or t
  modified_base (533)..(533): a, c, t, g, unknown or other
  misc_feature (533)..(533): n is a, c, g, or t
  modified_base (536)..(536): a, c, t, g, unknown or other
  misc_feature (536)..(536): n is a, c, g, or t
  modified_base (568)..(568): a, c, t, g, unknown or other
  misc_feature (568)..(568): n is a, c, g, or t
  modified_base (571)..(571): a, c, t, g, unknown or other
  misc_feature (571)..(571): n is a, c, g, or t
tcagtctacgtagccacgaccggtgctcgatttagtgctatagacttggggtttgggggggaagaggaagactgacggtccccccaggagttcgggctgagcgtgggttttcctgctgctatcttaaaaggtgtccagtgtgaagtgcaggtggtggagtcgtggggggagccttgggtaaagccgtgggggggtcccttagagtctcctgtgtggcctctggattcactttcagtaatggctggatgagttgggtccgccaggctcgagggaggggctggagtgggtgacgttanaaagtaaatgatggaganaaatagactaggngcaccgtagaaaggagattacaccatactacaagagaataaacttaacaaaaacgtacggtgtatttacgacaaatgaacacgaacctagaaccgagacacacgcctactattactgtaccanagnttacggaatgacatacgaagtaagagatatggttnttntatatcgtcggcgacggagaagtggtcgtcgtctctcttccnccnccgacgacgccgcgttccgtcctccctcgccnccncctcgaacgcg

SEQ ID NO: 347446 - DNA, 612 bp, Homo sapiens
  misc_feature: GZ8MTXP01EY2Y6.15.86.H09.1.454.CMB.2.raw
  modified_base (303)..(303): a, c, t, g, unknown or other
  misc_feature (303)..(303): n is a, c, g, or t
  modified_base (382)..(382): a, c, t, g, unknown or other
  misc_feature (382)..(382): n is a, c, g, or t
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
  modified_base (576)..(576): a, c, t, g, unknown or other
  misc_feature (576)..(576): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaagggggacggacnccccgatcgcttcagtgggctccgagttcgtgggctgaccgctacctccacctatcctccaaccctccacgtctgacgngtgagctgagtatnacgttggnggagagacgaccaacgacaagttgaattagggacccgtaaagggggtcggggtttggggtcggttcgggacgggtagggaccaaggcgtacggtaccgtcgtacggtcaacggcccgaaggtccttccgtccccgttacgggttccttaccgttcccgttccggttcccccncccttcccgtcgttcccgttaacggttcgtaaccgg

SEQ ID NO: 347447 - DNA, 616 bp, Homo sapiens
  misc_feature: GZ8MTXP01ATL1T.15.86.H09.1.454.CMB.2.raw
  modified_base (416)..(416): a, c, t, g, unknown or other
  misc_feature (416)..(416): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatacaacagagaccagggaactccccagtataataatagaaagtaagagtgatggcagaccacgaccgaagggggacggactccccgatcgcttcgagtggctccgtagttcgtggggctcgaccgctacctcccacctactcctacccaaccctaccacgtcgagacgatggacggctaggatatcacgtggngggaagagacaccgaacacgtaagttgagttacgggaccgaaagggggtcggggttggggtcggttccggggacgggacggaacaaggtcgtacggtacccggtcgtaggcaacggcccaagggtcccttaccggcccccgttacggccttacgttccgtccggttcccctcctccttacgttacgtaagttcgtcgggg

SEQ ID NO: 347448 - DNA, 685 bp, Homo sapiens
  misc_feature: GZ8MTXP01E2WFV.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatacaacagagaccgagggaacgtcccccagtatataatagaaagttaagagtgatggcagaccacgaaccggaagggggacggactccccgatcgcttcagtcgggctccgtagttcgtgggggctcgaccgtctacctcccacctactcctacccaaccctccagtcagacgagtgaggctagtagtatcacgtggaggagagacgaccaactactaagttgagtcgggaccgtaaagggggtcgggggtttggggtcggttacggggacggggtaacgggaacccgaaggtccgtacggtaccccggttacgtaacgggtccgaaccggacccgttaacgggtcccgttaccccgggcccccccgttcgggttacccgttaccgtttccccggttccccggtttccccccgtcccctttcccggtaccggttaccgttaaccgggttaacgtaacccggg

SEQ ID NO: 347449 - DNA, 632 bp, Homo sapiens
  misc_feature: GZ8MTXP01BJACH.15.86.H09.1.454.CMB.2.raw
  modified_base (307)..(307): a, c, t, g, unknown or other
  misc_feature (307)..(307): n is a, c, g, or t
tcagtctacgtagccacgaccggtgctcgatttagtgctatagacttgggtttggggggaagaggaagactgacggtcccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggagggctggagtgggttggacgttacaaaagtaaaatgatggngaagaaaatagactacggtgcaccgtagaaaggagattcaccatctacaagagaataaattacaaaaacgcggtagtatttgacaaatgaacagacctagaaaccgagacacagccgtactattactagtaccacagattacggaaagtgactatcggaaacgtaaaagggaggacttaagttggggtacttttttaggaattagtcggtcgggggacccaaggggaacctaagtcgggtcgtcgtctcttcagtcccttccgaaccgtaacgggcccagttccggtcccttccccgcggcccaccccttcctaaccgaacgccg

SEQ ID NO: 347450 - DNA, 666 bp, Homo sapiens
  misc_feature: GZ8MTXP01C0XLA.15.86.H09.1.454.CMB.2.raw
  modified_base (489)..(489): a, c, t, g, unknown or other
  misc_feature (489)..(489): n is a, c, g, or t
  modified_base (636)..(636): a, c, t, g, unknown or other
  misc_feature (636)..(636): n is a, c, g, or t
  modified_base (644)..(644): a, c, t, g, unknown or other
  misc_feature (644)..(644): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttggtccgccaggctcgagggagggctggagtgggttggacgtttacaaaagtaaaatgatggtagaagaaaatagactacggtgacaccgtagaaaggaagattcaccatactacaagagaataaattaacgaaaaacgtacggtagtatttacgacaaaatgaaacagaacctaagaaaccgaggaaccacgacgtccgtacttaacttacctagtaacccacgaagtagttacgggaaagtnactaagtcggaaacgttaaagggaggtactaattgggtacttttaggattacgtcgtcggggaccctagggaacagtcgggtctcgtctaacttcgacgtcccttcgaaaccgacgggccccttgttcccgggttcccttcccccgnggaccccncccgttactaaccgaaggtccg

SEQ ID NO: 347451 - DNA, 634 bp, Homo sapiens
  misc_feature: GZ8MTXP01AOXLF.15.86.H09.1.454.CMB.2.raw
  modified_base (352)..(352): a, c, t, g, unknown or other
  misc_feature (352)..(352): n is a, c, g, or t
  modified_base (417)..(417): a, c, t, g, unknown or other
  misc_feature (417)..(417): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggacgtcccccagtatataatgaaagttaagagtgatggcagccacacgaagggggacggatccccgatcgcttcatgggctccagttcgtggggctcgaccgctacctccaccntctacccaacctccagtctgacgatgaggctagagtactccgagtggtaggagagacgaccctanaactaattcgaatcgggacccaaagggggtcggggtttgggggtcgttccggggacggggaacggggaccaaaggtcgtacgggtaaccccgtccgtaaaggggtccaacggccccgttaaaggggcccttaccggtcccccccgtgggttcccttaccgttccttcccggttacccccctccccgttcccgtcggttaccgtaacggttaacgcgg

SEQ ID NO: 347452 - DNA, 532 bp, Homo sapiens
  misc_feature: GZ8MTXP01DLR74.15.86.H09.1.454.CMB.2.raw
  modified_base (406)..(406): a, c, t, g, unknown or other
  misc_feature (406)..(406): n is a, c, g, or t
  modified_base (501)..(501): a, c, t, g, unknown or other
  misc_feature (501)..(501): n is a, c, g, or t
  modified_base (521)..(521): a, c, t, g, unknown or other
  misc_feature (521)..(521): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacggatccccgatcgcttcagtgggctccagttcgtggggctgaccgctacctccaccatctccaacctccagtctgacgatgaggctgagtatcactgtggagagagccanacaattgatggaccaaggggcgggttggggtgttcgggcggagggaccaaggctgaccgtcgtaggcaagcccaagggccttcgccccctggccncttctcgtccccgccctccncgctcgttgcg

SEQ ID NO: 347453 - DNA, 621 bp, Homo sapiens
  misc_feature: GZ8MTXP01EIXCY.15.86.H09.1.454.CMB.2.raw
  modified_base (417)..(417): a, c, t, g, unknown or other
  misc_feature (417)..(417): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaccgaagggggacggatccccgatcgcttcatgggctccagttcgtggggctgaccgctacctcccaccatcctcccaaccctccagtctgacgatgaggctgagtatcgactggaggagacgacgccaanactaagttgagtcgggacccgaaagggggtcggggtttgggggtcgttacgggggacgggtaagggacccaagggccttacggaccccgttacgtaggccaacggtcccgaagggcccttccggccccccgttgggttccttacccgttcgttcccggtttccccccgcccttcccgtccgaccgttaaccggttgtaacccgg

SEQ ID NO: 347454 - DNA, 764 bp, Homo sapiens
  misc_feature: GZ8MTXP01BASKL.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgcgtgggagcctcgatcaagctcacctgccaccctaagtagtgagcatcgaacctacaccatcgaatggtatacaacagagacgagggaaccgtcccccagtatataatagaaagtaagagtagatggcacgccacgaaccgaagggggacggacgccccgatcgctcagtggctccgtagttcgtggggctcgaccgtctacctcccaccatccctacccaaccctccacgtcgtagaccgagtcggaggtcgtagtaagtactaccgaacggttgggtagggaaaggaaggaccgtacccaaactaaacctaaagttggaaacgttcgggaacccgaaaagggggttccggggggttttgggggtccggtttaccggggggacggggaaaccgggggtaacccaaaggggtcctaccgggtaaccccggttacccggtaacgggtccccggaaaccgggtacccccgaaggggtccccgttcccggtcccccccccggttagggttcccccttacccgtttccccggttccccggtttacccccccccctaaccccgtttccccggttcccggttaccccggttttaaacggaaccgggttcccggg

SEQ ID NO: 347455 - DNA, 583 bp, Homo sapiens
  misc_feature: GZ8MTXP01ACX3W.15.86.H09.1.454.CMB.2.raw
  modified_base (359)..(359): a, c, t, g, unknown or other
  misc_feature (359)..(359): n is a, c, g, or t
  modified_base (415)..(415): a, c, t, g, unknown or other
  misc_feature (415)..(415): n is a, c, g, or t
  modified_base (460)..(460): a, c, t, g, unknown or other
  misc_feature (460)..(460): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacgaccgaagggggacggactccccgatcgcttcatgggctccgagttcgtggggctgaccgctacctccaccatcnccaacctccagtctgacgatgagctgagtatcacgtggtagggagagacgcccaanacaagttgaatgggaccaagggggtacggttggggtgttcggggnggagggacccaagtccgtaggacccgttcgtaagggtcaacggccccgaagggccttcgcccccgtcggttccaccgttcctttcggtcccccgcccttacccgcgaccgtaacgttgaaccg

SEQ ID NO: 347456 - DNA, 650 bp, Homo sapiens
  misc_feature: GZ8MTXP01C4OT0.15.86.H09.1.454.CMB.2.raw
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacacatcgaatggtatcaacagagaccaagggaacgtccccccagtataataatagaaagttaagagtgatggcagccacgaccgaagggggacggactccccgatcgcttcatgggctccagttcgtggggctgaccgctacctccaccatctccaacctccagtctgacgatgaggctgatatcactgtggganaganccaanacaaattgatgggacccaaagggggtaccggggtttgggggtacgttccgggggacgggaaacgggggacccaaaggccttacggaacccgggttcctaacgggggtccaacgggaccccgaaagggtcccttccggtccccccccgtcgggtttacccaccgtttccccgttaaccgggtttcccccccggcccctttcccgtcccgggacttttaaccccgggaagggtaaccccg

SEQ ID NO: 347457 - DNA, 659 bp, Homo sapiens
  misc_feature: GZ8MTXP01D6PD5.15.86.H09.1.454.CMB.2.raw
  modified_base (335)..(335): a, c, t, g, unknown or other
  misc_feature (335)..(335): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacgaaccgaagggggacggatccccgatcgcttcagtggctccgagttcgnggggctcgaccgctacctccaccatcctccaacctcccagtctagacgatgaggctagagtatcatggtaggagagacgaccaacacaagttgaagtcgggacccgaaagggggtacggggtttgggggtacgttccgggggacggggaacgggaacccaaaggtcgtaccggtaacccggttcgtaacgggtcccaaggccccgaaaggggtcccttccgggacccccccgttggggttacccaacccggtttcctcccgggtttaccccccccaacccgttcccgttccgggaccctttaaccgggttaaccgtaaccgggg

SEQ ID NO: 347458 - DNA, 637 bp, Homo sapiens
  misc_feature: GZ8MTXP01B8MQC.15.86.H09.1.454.CMB.2.raw
  modified_base (301)..(301): a, c, t, g, unknown or other
  misc_feature (301)..(301): n is a, c, g, or t
  modified_base (328)..(328): a, c, t, g, unknown or other
  misc_feature (328)..(328): n is a, c, g, or t
  modified_base (400)..(400): a, c, t, g, unknown or other
  misc_feature (400)..(400): n is a, c, g, or t
  modified_base (411)..(411): a, c, t, g, unknown or other
  misc_feature (411)..(411): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggancccgatcgctcatgggctcgagttcgngggctgaccgctacctccaccatcctacccaacctccagtctgacgatgaggctgagtatcacgtgtggganagacgaccaanacgtaaattgagtcgggaccgaaagggggtacggggtttgggggtacgttccgggggacgggaacggggacccgaaaggcgtacggtaacccggttacccgtagggtccgaacggccccaaagggggtcccttcccggacccccccggttgggttccccaccgtttcccgtcccggttccccccgccccttccccggtcgttcccgttaaaccgttcgaacccggg

SEQ ID NO: 347459 - DNA, 566 bp, Homo sapiens
  misc_feature: GZ8MTXP01AU4BV.15.86.H09.1.454.CMB.2.raw
  modified_base (521)..(521): a, c, t, g, unknown or other
  misc_feature (521)..(521): n is a, c, g, or t
  modified_base (535)..(535): a, c, t, g, unknown or other
  misc_feature (535)..(535): n is a, c, g, or t
  modified_base (549)..(549): a, c, t, g, unknown or other
  misc_feature (549)..(549): n is a, c, g, or t
  modified_base (554)..(554): a, c, t, g, unknown or other
  misc_feature (554)..(554): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacggactccccgatcgcttcagtgggctccgagttcgtgggggctcgaccgctacctccaccactcctacccaaccctccacgtctagaccgagtggaggctagagttactcacgttggagggagagacgccaacaatattgactggaccgaaggggtacggggtttggggtggtcgggagggacggaccagtcgtcgtaccgtcgtaggcaacggtccgaggccnccgccccgtggccncttctccgtccccncctcncgctaacgcgcg

SEQ ID NO: 347460 - DNA, 617 bp, Homo sapiens
  misc_feature: GZ8MTXP01DICWM.15.86.H09.1.454.CMB.2.raw
  modified_base (271)..(271): a, c, t, g, unknown or other
  misc_feature (271)..(271): n is a, c, g, or t
  modified_base (289)..(289): a, c, t, g, unknown or other
  misc_feature (289)..(289): n is a, c, g, or t
  modified_base (427)..(427): a, c, t, g, unknown or other
  misc_feature (427)..(427): n is a, c, g, or t
  modified_base (455)..(455): a, c, t, g, unknown or other
  misc_feature (455)..(455): n is a, c, g, or t
  modified_base (487)..(487): a, c, t, g, unknown or other
  misc_feature (487)..(487): n is a, c, g, or t
  modified_base (500)..(500): a, c, t, g, unknown or other
  misc_feature (500)..(500): n is a, c, g, or t
  modified_base (571)..(571): a, c, t, g, unknown or other
  misc_feature (571)..(571): n is a, c, g, or t
  modified_base (591)..(591): a, c, t, g, unknown or other
  misc_feature (591)..(591): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctcgagggagggntggagtgggtgacgttanaaaagtaaaatgatggagaagaaaatagactacggtgaccgaccgtagaaaaggaagattcaaccatctacaaagagtaataaacttacaaaaacgtacggtatatttagacaaatgaaacagaacctaagaaaccgngaacacagccgtactatactgtaccaanagattacggaatgacaagtacgaagtaaaggngtctaagtcggtnttttagatagtcgtggggccagggtacagtggtcctcgtctctcacgtccttaccgaaccgaacgggcccngttcccggtcccttccccgngcccctacccttctaaccgaacgccg

SEQ ID NO: 347461 - DNA, 574 bp, Homo sapiens
  misc_feature: GZ8MTXP01E2LQU.15.86.H09.1.454.CMB.2.raw
  modified_base (559)..(559): a, c, t, g, unknown or other
  misc_feature (559)..(559): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacaccgaagggggacgggatccccgatcgcttcagtgggctccagttcgtgggggctgaccgctacctcccaccatcctccaaccctccagtctgacgatgaggctgagtatcacgtggtggagagacgccaacacaattgaagtggacccgaaggggtacgggttggggtggttcgggcgggagggaccaaggctcggtacccgtccgtagggtccaacgccccgaaaggcccttcgccccccgtcggccaccttctccgtccccaacccttccncgctaacgttaagcg

SEQ ID NO: 347462 - DNA, 641 bp, Homo sapiens
  misc_feature: GZ8MTXP01ALZR9.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaagggggacggatccccgatcgcttcatgggctcagttcgtgggctcgaccgctacctccaccatcctcccaacctcccagtctgacgatgagctgagtatcacgtgtggagagacgccaacacaaattgagtgggacccgaagggggtacggggtttgggggtcggttccggggacggggacgggaacccgaaggtccgtacggtaacccgtcccgtaaaggtcccgaaccggccccgttaaacggggcccttcccggcccccccgttcggggttccccgttaccttcccgttcccggttccccccaacccgttccccgtccgggacccttaacgggttaacgtaacccggg

SEQ ID NO: 347463 - DNA, 724 bp, Homo sapiens
  misc_feature: GZ8MTXP01CLYR3.15.86.H09.1.454.CMB.2.raw
  modified_base (214)..(214): a, c, t, g, unknown or other
  misc_feature (214)..(214): n is a, c, g, or t
  modified_base (270)..(270): a, c, t, g, unknown or other
  misc_feature (270)..(270): n is a, c, g, or t
  modified_base (288)..(288): a, c, t, g, unknown or other
  misc_feature (288)..(288): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtcgtgggggagccttggtaaagccgtggggggtcccttagagtctctgtgtggcctntggattcactttcagtaatggctggatgagttgggtccgcaggctcgagggagggntggagtgggtgacgttanaaaagtaaatgatggagaagaaaatagaacgtacggtgaccgaaccgtagaaaaggagtattacaaccatactacaaagaagtaataaacttaacaaaaaacggtacggttagttaatttacgaactaaaagtacgaaactaacgaaaccctaaacggaaaacccggaggaaaccaaaccgaccggtacccgttaacttaaattaacctacgtaaacccaagtaagtacgttaacgggaaagtcgaactagtaccgggaaaggaaaaggcggtacttaagtggggtttacttttaggattacgtcggtcggggacccaggaactagtcggtcgttcgtctcttcgcgtcccttccgaaaccggtacgggcccttacgttcccggttaaccctcccccgtggtacccctaccccttaccctaaccgaaacggtcccg

SEQ ID NO: 347464 - DNA, 525 bp, Homo sapiens
  misc_feature: GZ8MTXP01D7L09.15.86.H09.1.454.CMB.2.raw
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
  modified_base (406)..(406): a, c, t, g, unknown or other
  misc_feature (406)..(406): n is a, c, g, or t
  modified_base (415)..(415): a, c, t, g, unknown or other
  misc_feature (415)..(415): n is a, c, g, or t
  modified_base (452)..(452): a, c, t, g, unknown or other
  misc_feature (452)..(452): n is a, c, g, or t
  modified_base (494)..(494): a, c, t, g, unknown or other
  misc_feature (494)..(494): n is a, c, g, or t
  modified_base (505)..(505): a, c, t, g, unknown or other
  misc_feature (505)..(505): n is a, c, g, or t
  modified_base (512)..(512): a, c, t, g, unknown or other
  misc_feature (512)..(512): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagaccacaccgaagggggacggatccccgatcgcttcatgggctcgagtttcgtgggctgaccgctacctcccaccatcctcccaaccctcccagtctgacgatgaggctgagttancatggngganagacgccanacattgatggccaaggggtcgggttggggtgtcgggngacgggacagctgacgtctagcaagccaggcttcgccctgcncttctctcccncccttcncgctaacgttgcg

SEQ ID NO: 347465 - DNA, 638 bp, Homo sapiens
  misc_feature: GZ8MTXP01B3AJ7.15.86.H09.1.454.CMB.2.raw
  modified_base (378)..(378): a, c, t, g, unknown or other
  misc_feature (378)..(378): n is a, c, g, or t
  modified_base (403)..(403): a, c, t, g, unknown or other
  misc_feature (403)..(403): n is a, c, g, or t
  modified_base (577)..(577): a, c, t, g, unknown or other
  misc_feature (577)..(577): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccgagggaacgtcccccagtatataatagaaagttaagagtgatggcagccacgaccgaagggggacggactccccgatcgcttcagtgggctccagttcgtgggggctcgaccgctacctccaccatctacccacctccagtcngacgatgagctgagtatcacgtggnggaagagacgccaacaacaagttgaagtggggaaccctaaagggggtacgggggtttggggtcggttaccgggggacgggaacgggggaacccaaggtccgtacggtaccccggttccgtaagggtccaacggccccgaaaggggcccttaccggcccccccgttggttccccncgttcccttccggttccccccaaccccttcccgtccgttacccgttaacggttcgtaaccg

SEQ ID NO: 347466 - DNA, 590 bp, Homo sapiens
  misc_feature: GZ8MTXP01EIPT1.15.86.H09.1.454.CMB.2.raw
  modified_base (363)..(363): a, c, t, g, unknown or other
  misc_feature (363)..(363): n is a, c, g, or t
  modified_base (399)..(399): a, c, t, g, unknown or other
  misc_feature (399)..(399): n is a, c, g, or t
  modified_base (567)..(567): a, c, t, g, unknown or other
  misc_feature (567)..(567): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaccgaagggggacggatccccgatcgcttcagtgggctccgtagttcgtgggggctgaccgctacctcccacctancctacccaacctccagtctagacgatgagctgatancagtggtgagagacgccagactaattcgatcgggaccaaagggggtcgggttggggtacgttcgggagggagggaccaaggtctacggcccgtcgtacggcaacggtcccgaaggtcccgttccggcccccttggttacccgcttccgtccgtccccaacccgttccncgactttaacccggaagtaacgg

SEQ ID NO: 347467 - DNA, 690 bp, Homo sapiens
  misc_feature: GZ8MTXP01C7BTU.15.86.H09.1.454.CMB.2.raw
  modified_base (335)..(335): a, c, t, g, unknown or other
  misc_feature (335)..(335): n is a, c, g, or t
  modified_base (414)..(414): a, c, t, g, unknown or other
  misc_feature (414)..(414): n is a, c, g, or t
  modified_base (430)..(430): a, c, t, g, unknown or other
  misc_feature (430)..(430): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaccgaagggggacggactccccgatcgcttcagtgggctccgagtttcgngggggctcgacccgctacctccaccactcctacccaaccctccagtctgacgagtgacggctagagtatcgacgttggngggagagacgcccaanaacgtaattgaatacggggaacaaaggggggtacggggtttggggtcggttaccgggggacggggtaaagggggaaccccaaagggtcccgttacgggtaaccccggttccgtaacggggttacccgaacggtacccccgaaaggggtccccgttcccgggtcccccccgttggggttaccccttaccgtttccccgtcccgggttttccccccgccccttcccgtacggttacccgtttaaccggttaacggtaacccg

SEQ ID NO: 347468 - DNA, 634 bp, Homo sapiens
  misc_feature: GZ8MTXP01DJNAG.15.86.H09.1.454.CMB.2.raw
  modified_base (426)..(426): a, c, t, g, unknown or other
  misc_feature (426)..(426): n is a, c, g, or t
  modified_base (598)..(598): a, c, t, g, unknown or other
  misc_feature (598)..(598): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccaagtatataatgaaagttaagagtgatggcagccacgaccgaagggggacgggatccccgatcgcttcagtgggctcaggtttcgtgggggctgaccgctaccctccaccatcctacccaacctcccagtctgacgatgagctggatactcgagttggaggagagacgtccccaaanaatagtagagtacggaaccgtaaggggggtcgggtttggggtacggttacggggacgggaacggaccgaacggtccgtaccggtaccgtaccgtacgggtccaaccggcccgaacggtcccgttccccgtcccccggtcggttccttccgttcccgttccccgttacccccncccgttcccgaccggttaccgtaacggttaacggcg

SEQ ID NO: 347469 - DNA, 625 bp, Homo sapiens
  misc_feature: GZ8MTXP01EJR1K.15.86.H09.1.454.CMB.2.raw
  modified_base (595)..(595): a, c, t, g, unknown or other
  misc_feature (595)..(595): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaaatgatggtagaagaaaatagactacggtgacacccgtgaaaaggaagattcaaccatctacaaagagaataaattacaaaaaacgacggtagtatttagacaaaatgaaacagaccctagaaaccgagaacacagccgtctattactgtaccacagattcggaaagtgcatcgaacgtaaaaggaggactagtgtctttttgaattagtctgggggacccaggggaacaagtggtcgtcgtctcttcacgccttaccgaccgaaagggccccagttcccggtccttcccccgnggccctaccccttccctaaccaaagaaccg

SEQ ID NO: 347470 - DNA, 530 bp, Homo sapiens
  misc_feature: GZ8MTXP01ESTBI.15.86.H09.1.454.CMB.2.raw
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
  modified_base (498)..(498): a, c, t, g, unknown or other
  misc_feature (498)..(498): n is a, c, g, or t
  modified_base (512)..(512): a, c, t, g, unknown or other
  misc_feature (512)..(512): n is a, c, g, or t
  modified_base (517)..(517): a, c, t, g, unknown or other
  misc_feature (517)..(517): n is a, c, g, or t
  modified_base (527)..(527): a, c, t, g, unknown or other
  misc_feature (527)..(527): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagcacaccgaagggggacggatccccgatcgcttcatgggctccagttctgggggctgaccgctacctccaccatctccaacctccagtctgacgatgaggctgagtatcatgnganagagccaanacatgatcggacaaggggtgggttgggtgtacgggcggaaggaccagccgtggtacccgtcgtggcaacgcccgaggtccttccgccccgtgccncttctccgtccccncctcncgactaacgngcg

SEQ ID NO: 347471 - DNA, 625 bp, Homo sapiens
  misc_feature: GZ8MTXP01DVKJ3.15.86.H09.1.454.CMB.2.raw
  modified_base (405)..(405): a, c, t, g, unknown or other
  misc_feature (405)..(405): n is a, c, g, or t
  modified_base (421)..(421): a, c, t, g, unknown or other
  misc_feature (421)..(421): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagaccacgaccgaagggggacggactccccgatcgcttcagtggctcagttcgtggggctcgaccgctacctccaccatcctcccaaccctcccagtctgacgagtgaggctgagtatcacgtggnggaagagacgaccaanacaattgatcgggaccgtaaagggggtcggggtttggggtcggttcggggacgggtaacgggacccaaggccgttacggacccgttcgtaggtccgaacgccccgaaggtcccttccggccccccgttgggttccccttacgtttccgtcccgtttcccccaaccccgtttccgaccgttccgttaaccggttaagtaacccgg

SEQ ID NO: 347472 - DNA, 627 bp, Homo sapiens
  misc_feature: GZ8MTXP01AZWPT.15.86.H09.1.454.CMB.2.raw
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
  modified_base (422)..(422): a, c, t, g, unknown or other
  misc_feature (422)..(422): n is a, c, g, or t
  modified_base (567)..(567): a, c, t, g, unknown or other
  misc_feature (567)..(567): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccaacgaccgaagggggacgggacgtccccgatcgcttcatcgggctccgagttcgtgggggctcgaccgctacctcccaccatcctcccaaccctccagtctcgacgagtgagctgagtcncagtggnggaagaggacncctaacacaagttgagtcggaccgaaagggggtcggggtttggggtcgggttcgggacgggacgggaccgaaggtccgtacggtacccgtccgttaagggccaacggtccccgaagggcccttccgcccccccgttgggttcccnccttccgttcccggttcccccgtccctcccgtacggttaccttaaccggttaacgtccgg

SEQ ID NO: 347473 - DNA, 633 bp, Homo sapiens
  misc_feature: GZ8MTXP01DPJH9.15.86.H09.1.454.CMB.2.raw
  modified_base (455)..(455): a, c, t, g, unknown or other
  misc_feature (455)..(455): n is a, c, g, or t
  modified_base (470)..(470): a, c, t, g, unknown or other
  misc_feature (470)..(470): n is a, c, g, or t
  modified_base (478)..(478): a, c, t, g, unknown or other
  misc_feature (478)..(478): n is a, c, g, or t
  modified_base (514)..(514): a, c, t, g, unknown or other
  misc_feature (514)..(514): n is a, c, g, or t
  modified_base (527)..(527): a, c, t, g, unknown or other
  misc_feature (527)..(527): n is a, c, g, or t
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
  modified_base (579)..(579): a, c, t, g, unknown or other
  misc_feature (579)..(579): n is a, c, g, or t
tcagtctacgtagccacgaccggtgctcgatttagtgctatagacttgggttttggggggaagaggaagactgacggtccccccaggagttcgggctgagctgggttttccttgctgctatcttaaaaggtgtccagtgtgaagtgcaggtggtggagtctggggagccttggtaaaggcctggggggtcccttagagtctcctgtgtggcctctggattcactttcagtaatggctgatgagttggtccgccaggctccgagggaggggctgggagtgggttgacgtttacaaaaggtaaaatgatggtagaagaaaatagaactacggtcgaccgaaccgtaggaaaaggaagtattacacccatactacaaaggataaattaaataacgaaaaaacgtacggtattaatttagactaaagtacgaacacgaaccaacgaaccgaggacaacngtacctactattacngtaaccanagacttcggaattaggctaagtcggaaagtaaaggngtctagtaggttnttagtagtacgtcggtcggcggacggacgtacgtgtcgtctctctcncnccnccgaccgacgccgttcttcgtccctcccgtccgccacccacctaaccgaacgcg

SEQ ID NO: 347474 - DNA, 562 bp, Homo sapiens
  misc_feature: GZ8MTXP01BMZN8.15.86.H09.1.454.CMB.2.raw
  modified_base (422)..(422): a, c, t, g, unknown or other
  misc_feature (422)..(422): n is a, c, g, or t
  modified_base (528)..(528): a, c, t, g, unknown or other
  misc_feature (528)..(528): n is a, c, g, or t
  modified_base (542)..(542): a, c, t, g, unknown or other
  misc_feature (542)..(542): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatggtatcaacagagaccgagggaacgtcccccagtatataatagaaagttaagagtgatggcagccacgaccgaagggggacggactcccgatcgcttcagtcgggctccgtagttcgtggggctcgaccgctacctccaccatcctacccaacctaccagtctgacgatggagctagatatcagtggaggagagacgccaanactaattgaatcgggaccgaagggggtcggggtttggggtcgtcggggcggagggaccagcgtcgaccgtctagggcaacgcccgagggccttcggcccctggccncttctccgttcccncccttctcttacgtgcgtgg

SEQ ID NO: 347475 - DNA, 674 bp, Homo sapiens
  misc_feature: GZ8MTXP01B2NDX.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaactccccagtatataatagaaagttaagagtgatggcagaccaacgaccgaagggggacggactccccgatcgcttcagtgggctcgtagttcgtggggctcgaccgctacctcccaccatccctacccaaccctccacgtctagacgagtgaggctagagttatcgaacgtgggaggaagaacgacgacccaaaccataaagttgaacgttcgggaacccgtaaaaggggggtcggggttttgggggtacggtttaccgggggacggggaaacggggacccaaaggtcccgtacggtaccccgttccgtaacggggtccaaacgggaccccaagggggtccccttacccggcccccccgttgggttcccttaccgttcccttaaccggttcccccaacccgttcccgcgttacctaaccggttaacgaaccgg

SEQ ID NO: 347476 - DNA, 632 bp, Homo sapiens
  misc_feature: GZ8MTXP01DKVPJ.15.86.H09.1.454.CMB.2.raw
  modified_base (380)..(380): a, c, t, g, unknown or other
  misc_feature (380)..(380): n is a, c, g, or t
  modified_base (594)..(594): a, c, t, g, unknown or other
  misc_feature (594)..(594): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgccccgtctgcatctgccttgctgggagcctcgatcaagctcacctgcaccctaagtagtgagcatcgaacctacaccatcgaatggtatcaacagagacagggactccccagtatataatagaaagtaagagtgatggcacgaccacgaccggaagggggacggactccccgatcgcttcagtgggctccgtagttcgtgggctcgaccgctacctccaccactcctacccaaccctaccagtcngacgagtggacgctagagtatcacgttggaggagagaacgccaagacaagttgagttacgggaccgtaaagggggtacggggtttggggtcggttcgggacgggaacgggaccaaggtccgtacggtacccgttcgtacgggtcaaccggcccgaagggtcccttccggtccccccgttgggttacccttaccgttccgttccggtttaccccnccccgttcccgtccgttaccgttaaccggaagtaaccg

SEQ ID NO: 347477 - DNA, 724 bp, Homo sapiens
  misc_feature: GZ8MTXP01CFUX8.15.86.H09.1.454.CMB.2.raw
  modified_base (303)..(303): a, c, t, g, unknown or other
  misc_feature (303)..(303): n is a, c, g, or t
  modified_base (331)..(331): a, c, t, g, unknown or other
  misc_feature (331)..(331): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccagtatataatagaaagttaagagtgatggcagccacgaccgaagggggacggacnccccgatcgctcagtggctcgagttcgngggctcgaccgctacctccaccactcctacccaacctcctagtctgacgagtgacggctagagttatcaacggttggcgggaagacggaacgacccctaagaaacgtaagttcgggaaacttacgggggaccctaaagggggggttccgggggttttggggggttcggttaccggggggacggggtaaacgggggaacccgtaaacgggtccgttaccgggtaacccggtttaccggttacgggcccgaaccggaccccgaaacggggtccccttacccgggtcccccccgttaggggttccccttaccgttcccccgtttccggttacccccccctaaccccgtttcccgtacccgggttaccctttaacccgggttaacgggtaacccggg

SEQ ID NO: 347478 - DNA, 677 bp, Homo sapiens
  misc_feature: GZ8MTXP01D7LYV.15.86.H09.1.454.CMB.2.raw
  modified_base (369)..(369): a, c, t, g, unknown or other
  misc_feature (369)..(369): n is a, c, g, or t
  modified_base (379)..(379): a, c, t, g, unknown or other
  misc_feature (379)..(379): n is a, c, g, or t
  modified_base (646)..(646): a, c, t, g, unknown or other
  misc_feature (646)..(646): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttggtccgcaggctccgagggagggctggagtgggttggacgttacaaaagtaaaatgaatggtagaagaaaatagaactacggtgacaacccgtagaaaaggaagattacaccatactcaaaganaataaattanaaaaaacgcggtagtatttgactaaaatgaaacagaaccctaagaaacccgaggaaacaacgacgccgttactaattactagtaaccaacagattacggaaagtgacaataccggaaagtaaaagggaggtacttaagtggggtactttttaggaattacgtcggtcgggggaccctaaggggaactaaggttggtccgttcgtcctcttcacggcccttccgaaaccgtaacgggccccttagttcccggttcccctttcccccgnggcccctaccccttacctcccgaaaggtccg

SEQ ID NO: 347479 - DNA, 528 bp, Homo sapiens
  misc_feature: GZ8MTXP01B2FZH.15.86.H09.1.454.CMB.2.raw
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
  modified_base (408)..(408): a, c, t, g, unknown or other
  misc_feature (408)..(408): n is a, c, g, or t
  modified_base (494)..(494): a, c, t, g, unknown or other
  misc_feature (494)..(494): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaagggggacggatccccgatcgcttcatgggctccagttcgtggggctgaccgctacctcccaccatcctcccaacctccagtctgacgatgaggctgatancactggngagagagccanacaattgatggccaaggggcgggttggggtgtcgggcggagggaccaaggctgaccgtctaggcaagcccaggcttcgcccctgcncttctcgttccccaaccttccacgctaacgttgc

SEQ ID NO: 347480 - DNA, 619 bp, Homo sapiens
  misc_feature: GZ8MTXP01B8QTD.15.86.H09.1.454.CMB.2.raw
  modified_base (420)..(420): a, c, t, g, unknown or other
  misc_feature (420)..(420): n is a, c, g, or t
  modified_base (580)..(580): a, c, t, g, unknown or other
  misc_feature (580)..(580): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacgaccgaagggggacggatccccgatcgcttcatgggctccgagttcgtgggctcgaccgctacctccaccatctcccaacctccagtctgacgatgagctgagttactcacgtgtagggagaggacgaccctaaanaactaagtgagtacggaccgtaagggggtcggggtttggggcggtacgggacggaacggaccaggtccgtacggtacccgtacgtacggccaaccggacccgaggtcccgttcccggtcccccgttcggttacccttccgttcccgttcccgttcccccncccgttcccgtccggttaccgttaaccggttcggtaacg

SEQ ID NO: 347481 - DNA, 656 bp, Homo sapiens
  misc_feature: GZ8MTXP01D1RB9.15.86.H09.1.454.CMB.2.raw
  modified_base (278)..(278): a, c, t, g, unknown or other
  misc_feature (278)..(278): n is a, c, g, or t
  modified_base (344)..(344): a, c, t, g, unknown or other
  misc_feature (344)..(344): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccgagggaacgtcccccagtataataatagaaagtaagagtganggacacgccacgaaccggaagggggacggactccccgagtcgcttcgagtcggctcgtagtttcgnggggctcgaccgctacctcccaccactcctcccaaccctcagtctacgacgagtggaggctagagtactcgagtgggaggaagagacgaccaacaactaagttgagtacggaccgtaaaggggggtcggggtttggggttacggtacggggacggggaacggaaccaaggccgtcggtacccggttacgtacgggtcgaaccggcccggaaacggtcccttacccgggcccccttacgggttcccttacgttccctaacccggttcccccaacccgttcccgtacgttaccgttaaccggaacgtaaccggg

SEQ ID NO: 347482 - DNA, 646 bp, Homo sapiens
  misc_feature: GZ8MTXP01DD6KJ.15.86.H09.1.454.CMB.2.raw
  modified_base (338)..(338): a, c, t, g, unknown or other
  misc_feature (338)..(338): n is a, c, g, or t
  modified_base (387)..(387): a, c, t, g, unknown or other
  misc_feature (387)..(387): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcacctaagtagtgagcatcgaacctacacatcgaatggtatacaacagagaccgagggaacgtcccccagtatataatagaaagtaagagtgatggacagaccacgaccggaagggggacggactccccgatcgcttcagtcggctccgtagttcgnggggctcgaccgcctacctcccacctactcctacccaaccctccagtcngacgagtagacggtctagagtactcgaacgtgggtagggagaaggattaccaactaactagttagagtacggaccgaaaggggttcggggttggggtacggtccgggacgggtacggacctaaggccgtacggtaccgtacgtcggcaacggcccgaaaggggtcccttacccggtccccccgtcgggttacccttcccttcccgttccggttaccccccgccttccgccgttaccgttaaccgttaacgtaacccggg

SEQ ID NO: 347483 - DNA, 657 bp, Homo sapiens
  misc_feature: GZ8MTXP01BJO20.15.86.H09.1.454.CMB.2.raw
  modified_base (429)..(429): a, c, t, g, unknown or other
  misc_feature (429)..(429): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacgagggacgtccccagtatataatagaaagtaagagtgatggcagccacgaaccgaagggggacggacaccccgatcgtctcagtgggctcgtagttcgtgggctcgaccgctacctcccaccactcctacccaacctccagtcgtacgacgtatggagcgtgtacgtatcgacgtggagggaagagacgacccanaaactagttagacttgggaacccaagggggttacggggttgggggtacgtcgggggaccggaaggaccctaaagtcccggtcggtaacccgttcgtagggtccgaaccgcccggaaacgggtccccttaccgggtccccccttcggggttacccttaccgtttcccgttaacccgtttaccccccctccccgttccgtaccggttaccgttaaccggttaacgaacgg

SEQ ID NO: 347484 - DNA, 661 bp, Homo sapiens
  misc_feature: GZ8MTXP01DAA19.15.86.H09.1.454.CMB.2.raw
  modified_base (302)..(302): a, c, t, g, unknown or other
  misc_feature (302)..(302): n is a, c, g, or t
  modified_base (336)..(336): a, c, t, g, unknown or other
  misc_feature (336)..(336): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacacatcgaatggatcaacagagaccagggaacgtcccccagtatataatagaaagttaagagtgatggcagaccacgacgaagggggacggacnccccgatcgcttcgagtcgggctccgtagttcgnggggctcgaccgctacctcccaccactcacccaaccctccagtcgtagacgataggaggctaggagtattcgaagttgggaggaagaagacgaccaacaacgtaagttgaattcgggaacccaaagggggtcgggggtttagggggtggttaccggggacgggaaacggggacccaaaggtcgttaccggaacccggttccgtaaggtccgaacggccccgaaaggggtcccttccggtcccccccgttgggttacccttaccgttcccttcccggttaccccccaacccgttcccctcggacctttaacccggaaggtaacccg

SEQ ID NO: 347485 - DNA, 610 bp, Homo sapiens
  misc_feature: GZ8MTXP01C4LNZ.15.86.H09.1.454.CMB.2.raw
  modified_base (330)..(330): a, c, t, g, unknown or other
  misc_feature (330)..(330): n is a, c, g, or t
  modified_base (432)..(432): a, c, t, g, unknown or other
  misc_feature (432)..(432): n is a, c, g, or t
  modified_base (578)..(578): a, c, t, g, unknown or other
  misc_feature (578)..(578): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacacatcgaatggtatcaacagagaccagggaactccccagtatataatagaaaataagagtgatggcagccacgaaccgaagggggacggactccccgatcgctcagtggctccgagttcgngggctcgaccgctacctcccaccactcctacccaacctaccagtcctgaccgtagtggacggctagagtacttcgaacgttggaggagaacgagaccctaanactaagttgagttacggaccgaagggggtaccggggttggggtcgtcgggacggacggacaagcgtcgtaccgtcgtaggaccaacggcccgttaagggccttacccggccccttcggttccttaccgttccgtcccgttaccccncccttccgtcgttaccgtaaccgttcgaaccg

SEQ ID NO: 347486 - DNA, 754 bp, Homo sapiens
  misc_feature: GZ8MTXP01D77SM.15.86.H09.1.454.CMB.2.raw
  modified_base (339)..(339): a, c, t, g, unknown or other
  misc_feature (339)..(339): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgccaccctaagtagtgagcatacgaacctacacatcgaatgtatcaacagagaccgagggaacgtcccccagtataataatagaaagttaagagtgatggcacgaccacgaaccggaagggggacggactcccgatcgcttcagtgggctcgagttcgngggctcgaccgctacctccaccactcctacccaaccctcccgtatccgtagaaccgtagttcggacggtcgtacggtagtactccgtaggtaggtagggaaggacgaacggacccaacaaccttaagttaggtaacgtacggggaaccccgggtaagggggttaccgggggtttagggggtttacgggttaccgggggacgggggaaccggggaaccgaaccggtaccggtaccgggtacccgggttaccgtacgggtccgaaaccggtcccggaaaccgggtcccgttaaccccgggtccccccgttccggggtttacccgttcctttccccgtttaaccccgggttaaccccccgtaaccccttccccggttaccggttacccgtttaaccgggttaacgggttaacccgggg

SEQ ID NO: 347487 - DNA, 673 bp, Homo sapiens
  misc_feature: GZ8MTXP01DWPRT.15.86.H09.1.454.CMB.2.raw
  modified_base (333)..(333): a, c, t, g, unknown or other
  misc_feature (333)..(333): n is a, c, g, or t
  modified_base (374)..(374): a, c, t, g, unknown or other
  misc_feature (374)..(374): n is a, c, g, or t
  modified_base (390)..(390): a, c, t, g, unknown or other
  misc_feature (390)..(390): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtataataatagaaagttaagagtgatggcagccacgaccgaagggggacggactccccgatcgctcagtggctcgagttcgngggctgaccgctacctcccaccatcctccaacctccagtcngacgatgagctgagtntcacgtggtggagagaacgccaacgtaacaagttagagtacgggacccgtaaagggggtacggggtttggggtcgggtttaccggggacggggaaacggggaacccgtaagggtacccgtccggtaacccggttacccgtaacgggtacccgaacggtaaccccgaaagggggtccccttacccgggtcccccccgttcggggttacccaccgtttcccggtcccggtttacccccggcccggttaccgtaaccggttacggaaccgttcgggggtaaccggg

SEQ ID NO: 347488 - DNA, 831 bp, Homo sapiens
  misc_feature: GZ8MTXP01ENQCQ.15.86.H09.1.454.CMB.2.raw
  modified_base (144)..(144): a, c, t, g, unknown or other
  misc_feature (144)..(144): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcacgcccccgtntgcatctgccttgctgggagcctcgatcaagctcacctgcaccctaagtagtgagcatcgaacctacaccatcgaatggtatcaacagagaccgagggaacgtccccagtatataagtagaaagtaagagtgatggcacgaccaacgacggaacggggggacggactaccccgatcgcttcagtcgggctaccgtagttcgtggggctacgaccgactacctcccacctactacctaccctaaccctaccgaacgttccgtaggacccgtaagtgggtaggtaccgtaggtaaggttaactccgtaaggttaggggtaagggaacggaaaggttacccggaaacccgaaacctaaacggtaaacgtttacgggaagtaacggggtaaaccccggtaaagggggggggtttcccggggggtttaggggggtttaccgggtaccggggggtacgggggtaaaccggggtaacccgaaggggttacccggttaccgggttaaaccccgggttcccggtttaaacggggtcccgggtaaacccggtccccgggaaaacgggggtccccctttaaaccccgggtccccccccggttaacgggttcccgtttacccttacccgtttaaccccgggtccccctaaccccttccccgtaaccgttaccgttaaccgggttaacgttaacccgggg

SEQ ID NO: 347489 - DNA, 645 bp, Homo sapiens
  misc_feature: GZ8MTXP01CUZM0.15.86.H09.1.454.CMB.2.raw
  modified_base (298)..(298): a, c, t, g, unknown or other
  misc_feature (298)..(298): n is a, c, g, or t
  modified_base (540)..(540): a, c, t, g, unknown or other
  misc_feature (540)..(540): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctcgagggagggctggagtgggtgacttataagaaaataagnagtgagaaagtaagacgacgtgcaccgtacggaaaggaaaggatctaccactactcaagaagaataattactaaaacgaaacggtgtatttacgtacaaactagtaacaacgaacccgtacgaaaccggaaacggaacgaaccaacgacccgtacgttaacttaactacgtaccaaaccaagagttaccggtaaggagtccaatacggtacggaaaagagggcctataggtcttttgttaanagtcgcgggaccgaggatagtggtcgtcgtctctcacgcccaccgaccgacggacccgttcttcccggttccctccccgtcgcctaccccttaccctcgaacgcg

SEQ ID NO: 347490 - DNA, 580 bp, Homo sapiens
  misc_feature: GZ8MTXP01DYLLZ.15.86.H09.1.454.CMB.2.raw
  modified_base (254)..(254): a, c, t, g, unknown or other
  misc_feature (254)..(254): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (321)..(321): a, c, t, g, unknown or other
  misc_feature (321)..(321): n is a, c, g, or t
  modified_base (337)..(337): a, c, t, g, unknown or other
  misc_feature (337)..(337): n is a, c, g, or t
  modified_base (372)..(372): a, c, t, g, unknown or other
  misc_feature (372)..(372): n is a, c, g, or t
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
  modified_base (518)..(518): a, c, t, g, unknown or other
  misc_feature (518)..(518): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctggggggagccttgggtaaagccgtggggggtcccttagagtctcctgtgtggcctctggattcactttcagtaatggctggatgagttggtccncaggctcgagggagggctggagtgggtgagttacaaaagtaaangatggngaagaaatgactaggtnacaccgtagaaagganattcaccatctacaagagaataagttacaaaacgngtagtattgacaaatgaacagaaccctagaaccgagactacagaccgtntagttacngtacacaggatcgggaatgacatcgaagtaaagggngtatgtgtnttagatcgtcggacggcgaaggactagtcgtctctctctcgccnccaccgaccgacggcccttcgttcccgtcccctcccgcgccctacccttcctaacaacgccg

SEQ ID NO: 347491 - DNA, 582 bp, Homo sapiens
  misc_feature: GZ8MTXP01A6UKS.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggacgtcccccagtatataatagaaagttaagagtgatggcagccacaccgaagggggacggatccccgatcgcttcatgggctcgagttcgtgggggctgaccgctacctccaccatcctccaaccctccagtctagatgatgaggctagagtatcactggtaggagagacgccaacaactaattgatgggaccgaaggtacggggtttggggtcgttcgggggcgggaacgggaccgaaggtccgtggaacccgtccgtagggccacggcccgaagggccttaccgccccgttcggttccacgttcctcgttccccgccctccttcggtccttaacggtaacg

SEQ ID NO: 347492 - DNA, 681 bp, Homo sapiens
  misc_feature: GZ8MTXP01D9CJS.15.86.H09.1.454.CMB.2.raw
  modified_base (272)..(272): a, c, t, g, unknown or other
  misc_feature (272)..(272): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
tcagtctacgtagccacgaccggtgctcgatttagtgctatagacttgggtttggggggacttccctggtctccttctacctactgcccttcatttttctccacaggtctctgtgctctgcctgtgctgactcacgcccccgtctgcatctgccttgctgggagcctcgatcaagctcacctgcaccctaagtagtgagcatcgaacctacacatcgaatgtatcaacagagacgaggaacgtccccagtatataatagaaagtagagtgangcagcacgacgaaggggacggacncccgancgctcagtggctcgagttcgtgggctcgaccgctacctcccaccatcctacccacctaccagtcagacgagtgaggctagagtatcgagtggaggagagacgaccaagactaagttgaacgtcgggaccgtaaaggggggttcggggtttgggggttcggtaccgggggacgggaaacgggaaccctaggtaccgtacgggtacccgttacggggtaacggccgaaaccgggccccgttaaggggtccccttccccggtccccccccgtttaggggttaccccttacccgggtttcccgtttcccccgggtttaccccccggcccccttttcccgggtcccggttaaccggttttaaacggggttaaccgttcccgggg

SEQ ID NO: 347493 - DNA, 665 bp, Homo sapiens
  misc_feature: GZ8MTXP01BNLKQ.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccagtatataatagaaagttaagagtgatggcagccacacgaagggggacggactccccgatcgcttcagtggctccgagttcgtggggctcgaccgctacctccaccactcctacccaaccctccagtcgtacgacgatggaggtcgtagacgttatcaacgtggtaggagagacgcccaacgactaagttcgagtacgggacccgtaaagggggtacggggtttgggggtacggttcggggacgggaacgggggaacccaaaggccgtacgggtacccggttaccgttaacgggggcccaacggccccgaaaggggtcccgttaccggcccccccgttagggttccttacccgttccgttaacccgttccccctaaccccgttcccgtcggacccgtttaacggttaacgtaaccgg

SEQ ID NO: 347494 - DNA, 816 bp, Homo sapiens
  misc_feature: GZ8MTXP01A3PDR.15.86.H09.1.454.CMB.2.raw
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggccgcaggctcgagggagggctggagtgggtgacgttanaaagtaaaangatggtagaagaaatagactacggtgacgaaccgtagaaaggaagattacaccatctacaaagagtaataaattaacgaaaaaacgtacggttagttaatttacggaactaaaagtacgaaaccaacgtaaacccgtaaaggaaaacccggaagggaaacccaaccgaacggtcccgttaacttaaactttaaccgtacggtaaacccaacgtaaggtaacgtttaccgggaaaggttcgaactaacgtaaccgggtaaacgggtaaaaggggtaggtacctttaagttcgggttacgtttttagaacgttacggtaccgggtacgggggaccccgtaaaggggtaaaccctaaggttccggggttacccgttccggttaccttccgttaccgaccggtaccccttaaccccgaaacccggaacccggggttccccttacggttcccccgggttcccccttccccccgtcgggtaccccctacccccgtttacccctaacccgaaacgggtaaccccgg

SEQ ID NO: 347495 - DNA, 612 bp, Homo sapiens
  misc_feature: GZ8MTXP01A9J0Y.15.86.H09.1.454.CMB.2.raw
  modified_base (291)..(291): a, c, t, g, unknown or other
  misc_feature (291)..(291): n is a, c, g, or t
  modified_base (443)..(443): a, c, t, g, unknown or other
  misc_feature (443)..(443): n is a, c, g, or t
  modified_base (475)..(475): a, c, t, g, unknown or other
  misc_feature (475)..(475): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccgagggagggctggagtgggttggacgttanaaaagtaaaatgatggagaagaaaatagactacggtgcaccgtagaaaggagatcacatctacaagagaataaattacaaaaacgtacggtagtatttagacaaatagaacagaacctagaaaccgagacaacagcgtatatactgtaccanagattcggaatgcaatcggaaacgtaaagggngtctatcggtcgttttgattagtcgcggggcccagggacagttcgggtctcgtctcgttcacgtcccttaccgaccgtaagggccccttgttcccggtccctcccccgtggccctacccttccgtaaccaacggccg

SEQ ID NO: 347496 - DNA, 618 bp, Homo sapiens
  misc_feature: GZ8MTXP01CX579.15.86.H09.1.454.CMB.2.raw
  modified_base (331)..(331): a, c, t, g, unknown or other
  misc_feature (331)..(331): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtccccagtatataatagaaagttaagagtgatggcagccacaccgaagggggacggactccccgatcgcttcatggctccgagtttcgngggggctgaccgctacctccaccatcctcccaaccctccaagtctgacgagtcgaggctagagttatcgaactgggtaggaagaggaacgtccaaacaacgtaattgaagtcggaacccgaaaggggtcggggtttggggtggttaccggggacggaaggggaccaaggccgtgtacccgtcgtaacggtccaacggcccgaagggtccttaccggtcccccctgggttccacgttcccgtccgttcccccgccccttaccgtcggttaccttaacggaagtccggg

SEQ ID NO: 347497 - DNA, 672 bp, Homo sapiens
  misc_feature: GZ8MTXP01AVSMW.15.86.H09.1.454.CMB.2.raw
  modified_base (415)..(415): a, c, t, g, unknown or other
  misc_feature (415)..(415): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagtaagagtgatggcagccacaccgaaggggacggatccccgatcgcttcagtggctcagttcgtggggctgaccgctacctccaccatcctcccaacctccagtcagacgatgagctgagtatcacgtggtaggaagacgacgacccaaanacgtaaagttcgaagttacgggacccgtaaaggggggtaccggggtttgggggtcggttccggggacggggaacgggggaaccctaaagggtcccgttacgggtaaccccggttaccgtaaggggtcccaacggtccccggaaagggtcccttcccgggccccccccgtttaggggttcccttaccgttcccgttcccggttcccccccggtccccttccccgtccggttaccttaaccgggttaacgtaacccggg

SEQ ID NO: 347498 - DNA, 720 bp, Homo sapiens
  misc_feature: GZ8MTXP01EYUHX.15.86.H09.1.454.CMB.2.raw
  modified_base (277)..(278): a, c, t, g, unknown or other
  misc_feature (277)..(278): n is a, c, g, or t
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (430)..(430): a, c, t, g, unknown or other
  misc_feature (430)..(430): n is a, c, g, or t
  modified_base (433)..(433): a, c, t, g, unknown or other
  misc_feature (433)..(433): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccgagggaacgtccccccaagtactatatagtaagtaagtagnntncncncncncncncncncnctaacggggggaaccgggggtaaccggtacccccggtacttccttccgttccgtacgtcgggtccgttacccgtacggttccgtcggggtccccgtcgtaccgccctaccctccctaaccctacctcctccnccncgccgtcgtacgtctactactacgtcgtacgtacgtacgtacgtacgtacgtacgtacgtacggacgacgacgaccgaccgtacgtacgtacggtacggtaccggtaccggtacgggtacgggttacgggtaccgggtaccgggtaccgggtaccggaaccggtaaccggtaccgttaccggtacccggttacccggtacccggtacccgttacccgttcccgttacccggtcccgtccccgtccccgttcccgttacccgttacccgttccccgttcccgtccccg

SEQ ID NO: 347499 - DNA, 543 bp, Homo sapiens
  misc_feature: GZ8MTXP01AC7O8.15.86.H09.1.454.CMB.2.raw
  modified_base (398)..(398): a, c, t, g, unknown or other
  misc_feature (398)..(398): n is a, c, g, or t
  modified_base (412)..(412): a, c, t, g, unknown or other
  misc_feature (412)..(412): n is a, c, g, or t
  modified_base (448)..(448): a, c, t, g, unknown or other
  misc_feature (448)..(448): n is a, c, g, or t
  modified_base (489)..(489): a, c, t, g, unknown or other
  misc_feature (489)..(489): n is a, c, g, or t
  modified_base (501)..(501): a, c, t, g, unknown or other
  misc_feature (501)..(501): n is a, c, g, or t
  modified_base (537)..(537): a, c, t, g, unknown or other
  misc_feature (537)..(537): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacagggaactcccccagtatataatagaaagttaagagtgatggcagccacgaccgaagggggacggactcccgatcgcttcagtggctcgagttcgtgggctcgaccgctacctccaccatcctacccaacctccagtctgacgatgaggctgagtatcagtggnggagagacgaccanacaattgatggaccaaggggtcggttgggtgtcggnggaggccaagccgtgccgtcgaggtcaacgcccaagggccncgccccgtggcnccttcctccgttccccaacccttccgcgcgtaacgngtaacg

SEQ ID NO: 347500 - DNA, 624 bp, Homo sapiens
  misc_feature: GZ8MTXP01C1V56.15.86.H09.1.454.CMB.2.raw
  modified_base (551)..(551): a, c, t, g, unknown or other
  misc_feature (551)..(551): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatgtatcaacagagacagggacgccccagtatataatgaaagttaagagtgatgcagccacaccgaaggggacggactcccgatcgctcagtggctccgagtttcgaggggctcgaccgctacctccaccctactcctacccaaccctaccctacgtcctagaccgagtcgaggctagaagttatccaggttgagggagaggaacaccaacacgaaagtttgacgttacgggcccgtaaaagggggtcggggtttggggtagtcggggacggaacgggaaccaggcctacggtaccccgtacgttacgggccgaacggcccttaaaggggtccncccgtcccccgtgggttcccttaccgttccgttccgtccccggcccttccgcgttacgtaaccgttcgaaccg

SEQ ID NO: 347501 - DNA, 698 bp, Homo sapiens
  misc_feature: GZ8MTXP01AXQW7.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccgagggaacgtccccagtatataatagaaagttaagagtgatggcagccacgacgaagggggacggactccccgatcgcttcagtgggctcgtagttcgtggggctcgaccgctacctcccacctatccctacccacctaccagtctgacgagtgaggtctagagttactcaacggttgggagggaagaacggacgaccctaacgaactaaagttgggaaacgttcggggaaccaaaggggggggttcccggggtttggggggtacgttaccggggggaacgggtaaccggggaacccaagggtcccgtacgggtaaaccccgttccgtaagggtcccaacgggcccccgaaggggtcccttccccgggaccccccgtttggggttacccttcccggtttccgttccccggtttccccccgaacccttcccggtcgggttacccttaacgggttcggaacccgg

SEQ ID NO: 347502 - DNA, 555 bp, Homo sapiens
  misc_feature: GZ8MTXP01DJ66S.15.86.H09.1.454.CMB.2.raw
  modified_base (412)..(412): a, c, t, g, unknown or other
  misc_feature (412)..(412): n is a, c, g, or t
  modified_base (503)..(503): a, c, t, g, unknown or other
  misc_feature (503)..(503): n is a, c, g, or t
  modified_base (517)..(517): a, c, t, g, unknown or other
  misc_feature (517)..(517): n is a, c, g, or t
  modified_base (538)..(538): a, c, t, g, unknown or other
  misc_feature (538)..(538): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcacctaagtagtgagcatcgaacctacacatcgaatggtatcaacagagaccagggaacgtcccccagtatataatagaaagttaagagtgatggcagccacgaaccgaagggggacggactccccgatcgcttcatgggctcgagttcgtggggctcgaccgctacctccaccatcctaccaacctccatctgacgatgagctgagtatcactggtggagagacgccaanaacaattgatgggaaccaagggggtacgggttggggtcgtacgggacgggacggacaaggctgaccgtcgtagggcaacgtcccagggccnccgccccgtggccncttccgtcgtccccgccctcncgctaacgttgtaaccg

SEQ ID NO: 347503 - DNA, 653 bp, Homo sapiens
  misc_feature: GZ8MTXP01CUB4H.15.86.H09.1.454.CMB.2.raw
  modified_base (438)..(438): a, c, t, g, unknown or other
  misc_feature (438)..(438): n is a, c, g, or t
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgccacctaagtagtgagcatacgaacctacacatcgaatggtatacaacagagaccgagggaacgtccccagtatataatagaaagtaagagtgatggacacgaccaacgaaccggaagggggacggactccccgatccgtctacgagtcgggctcgtaggtttcggtcggggctacgacccgctacctcccacctactcctacccaaccctaccacgtctagacgagtggacggactaggtatactcgagttgggnggaagacggacncccaaanacaagttcgaagtacggaccgtagggggtacggggtttggggtacgtacgggacgggaacggaccaaggtccgtacggtacccgtcgtaacgggcaaccggccgaggtcccgccgtacccccgttggaaccccttcgttcccgttcccgttaccccctaaccgttcgtaccgacgttaaccgggttaagtcccggg

SEQ ID NO: 347504 - DNA, 618 bp, Homo sapiens
  misc_feature: GZ8MTXP01B1RII.15.86.H09.1.454.CMB.2.raw
  modified_base (304)..(304): a, c, t, g, unknown or other
  misc_feature (304)..(304): n is a, c, g, or t
  modified_base (331)..(331): a, c, t, g, unknown or other
  misc_feature (331)..(331): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (579)..(579): a, c, t, g, unknown or other
  misc_feature (579)..(579): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcacctaagtagtgagcatcgaacctacaccatcgaatggtatacaacagagacgaggaacgtccccagtatataatagaaagttaagagtagagtggcagaccaacgacggaaggggacggacncccgatcgctcagtggctcgagttcgnggggctcgaccgctacctcccacctatcctacccaaccctcacgtctacgacgagtagacgcgtagagtactcaagttggaggagagacgtaccanaanattgagtcgaaccaagggggtcggttggggtcgtacggggacggacgggaccaaggtcctacggacccgttacgacggcaaaccggcccaacgggtcccttccggcccccgttcggttaacccttccgttcccggttcccgttcccccncccgttcgtcccggaccgttaaacggttcgtaaccgggg

SEQ ID NO: 347505 - DNA, 673 bp, Homo sapiens
  misc_feature: GZ8MTXP01DBGTE.15.86.H09.1.454.CMB.2.raw
  modified_base (298)..(298): a, c, t, g, unknown or other
  misc_feature (298)..(298): n is a, c, g, or t
  modified_base (329)..(329): a, c, t, g, unknown or other
  misc_feature (329)..(329): n is a, c, g, or t
  modified_base (602)..(602): a, c, t, g, unknown or other
  misc_feature (602)..(602): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaactccccagtatataatgaaagtaagagtgatggcagccacgaccgaaggggacgganccccgatcgctcagtgggctcctagtttcgnggggctcgaccgctacctcccaccatcctacccaaccctccacgtctgacgagtgaggctgagtattcacgttggtggaagaacgagccctaacaacgtaaagttggaacgttacggggaccctaaaggggggttaccggggtttgggggttacggttcgggggacggggaacggggaacccaaagggtccgtacggtacccgttaccggtaaggggtcccaaacgggccccgaaacgggggtccttcccgggtccccccgttcgggttaccncccgtttccgttccccgttacccccaaccccctttccgtaccccgttaacggttaacgaacccggttgggg

SEQ ID NO: 347506 - DNA, 559 bp, Homo sapiens
  misc_feature: GZ8MTXP01AP1NN.15.86.H09.1.454.CMB.2.raw
  modified_base (511)..(511): a, c, t, g, unknown or other
  misc_feature (511)..(511): n is a, c, g, or t
  modified_base (523)..(523): a, c, t, g, unknown or other
  misc_feature (523)..(523): n is a, c, g, or t
  modified_base (545)..(545): a, c, t, g, unknown or other
  misc_feature (545)..(545): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaaggggacggatccccgatcgcttcagtcgggctccgagttcgtgggctcgaccgctacctccacctatcctccaacctccacgtctgacgatcgaggctgagtactcactggaggagagacgaccaacacaagttgatagggtacccaagggggtacgggtttggggcgttcgggacgggacgggaccaaggcgtgaccgtctaagggccaagcccgaggcncgcccctgttcncgttctccgtccccaaccctcncgcctaacgttgcg

SEQ ID NO: 347507 - DNA, 585 bp, Homo sapiens
  misc_feature: GZ8MTXP01B2ULS.15.86.H09.1.454.CMB.2.raw
tcagtctacgtagccacgaccggtgctcgatttagtgctatagacttgggtttggggggacttccctagtctccttctacctactgcccttcattttctccacaggtctctgtgctctgcctgtgctgactcagcccccgtctgcatctgccttgctgggagcctcgatcaagctcacctgcaccctaagtagtgagcatcgaacctacacatcgaatggtatcaacagagaccagggaacgtcccccagtatataatagaaagttaagagtgatggcagccacgacgaagggggacggactccccgatcgcttcagtgggctcagttcgtggggctcgaccgctacctccaccatcctcccaacctccacgtctgacgatgaggctgagtatcactgtggagagacgccacacagttgatggaccgaaggggcgggttgggtgttacgggcgggaggaccgaagcgtcgtaccgtcgtaggtcaacggccccgaaagggccttccggtcccccgtcgggttccaccgtttccgttccgttccccctaacccgttcccgtccgttacctaacggttcgtaaccgg

SEQ ID NO: 347508 - DNA, 665 bp, Homo sapiens
  misc_feature: GZ8MTXP01C6T5V.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacagggaactccccagtatataatgaaagttaagagtgatggcagccaacgaccgaagggggacggactccccgatcgctcagtggctcgtagttcgtgggctcgaccgctacctccaccactcctacccaacctccagtctgacgagtgacggtctaggattactcaagttgggagggaacgaaggacacccaaacaacgtaaagtttcggaagttacggggaaccccgtaaaggggggtttccgggggtttgggggttcggttaccgggggacgggaacggggacccaaagggtcccgtacggtacccgttccgtaaggcccgaacggaccccgaagggtccccttccggtccccccgtaggttcccaccgtttcccgtcccggtttcccccaacccgttcccgtacgttaccgttaacgaacgtaaccgg

SEQ ID NO: 347509 - DNA, 598 bp, Homo sapiens
  misc_feature: GZ8MTXP01CYK3N.15.86.H09.1.454.CMB.2.raw
  modified_base (276)..(276): a, c, t, g, unknown or other
  misc_feature (276)..(276): n is a, c, g, or t
  modified_base (383)..(383): a, c, t, g, unknown or other
  misc_feature (383)..(383): n is a, c, g, or t
tcagtctacgtagccacgaccggtgctcgatttagtgctatagacttgggtttggggggacttccctggtctccttctacctactgcccttcattttctccacaggtctctttgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtganggcagccacgaccgaaggggacggatccccgatcgcttcagtggctcagtcgtggggctgaccgctacctcaccccatctccaacctccaagtctgacgagtgagcngagtatcgagtggtaggagacgacgaccaacgactaagttgaagtcgggaccgtaagggtacgggggtttgggggtcggttcggggacgggagggaacccaaggcgtacggaccgtccgtacggtcgacgaaccccgaaggcctacccggcccctcgggtccttaccgttccttccgttccccacccgtccttccgcttacggtaacgcgtcggg

SEQ ID NO: 347510 - DNA, 650 bp, Homo sapiens
  misc_feature: GZ8MTXP01EGB29.15.86.H09.1.454.CMB.2.raw
  modified_base (392)..(392): a, c, t, g, unknown or other
  misc_feature (392)..(392): n is a, c, g, or t
  modified_base (414)..(414): a, c, t, g, unknown or other
  misc_feature (414)..(414): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccagtatataatagaaagttaagagtgatggcagacacgacgaagggggacggacgtcccgatcgctcagtggctcagttcgtgggctcgaccgctacctccaccactcctacccacctccagtctgacgatgaggctagatactnacgtggtaggagagacgccaanactaattgagtacggggacctaaaggggggtcggggtttggggtcggttacgggggcggaacgggggacccaaggtccgttcgggaaccccgttacgtacggggtccaacggtaccccgaaaggggtccccttaccggtcccccccgttaacgggttcccaccgtttcccgttcccgttacccccctaaccccttcccgtcccggttaccgtttaaccgggttaaccgtaaccggg

SEQ ID NO: 347511 - DNA, 657 bp, Homo sapiens
  misc_feature: GZ8MTXP01A2DRQ.15.86.H09.1.454.CMB.2.raw
  modified_base (418)..(418): a, c, t, g, unknown or other
  misc_feature (418)..(418): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacagggaacgtcccccagtatataatagaaagttaagagtgatggcagccacgaccgaagggggacggacgtccccgatcgctcagtggctcgagttcgtggggctcgaccgcctacctcccaccactcctacccaacctccacgtctagacgagtggagcgtagagtactctaacgtggtagganagacgccaactacgaagttcgaagttcgggaaccctaaaggggggttccgggggtttgggggtacggttccgggggacgggaacggggaacccaaaggtccgtacggtaccccgggttaccgtagggtccgaacggaccccgaagggtcccttcccggcccccccgttgggttaccttaccgttccgttcccggtacccccctaaccgttccgtccggttaccttaacggcgtaaccgg

SEQ ID NO: 347512 - DNA, 581 bp, Homo sapiens
  misc_feature: GZ8MTXP01AWG3R.15.86.H09.1.454.CMB.2.raw
  modified_base (403)..(403): a, c, t, g, unknown or other
  misc_feature (403)..(403): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaagggggacggactccccgatcgcttcagtgggctccgagttcgtggggctgaccgctacctccaccatcctccaaccctccagtctgacgatgaggctgagtatcacgttggnggagagagcctaacactaaattgaagtgggacccaaggggaccgggtggtgggtcgggtcgggacgggacgacgacggtcgtaccgtaccgtacgtcgaacgaccgaccggacgccgtccccgtcccgttcgttcccttcgtccgtcccgtccccgacctccgcgtaacgttcgaacg

SEQ ID NO: 347513 - DNA, 674 bp, Homo sapiens
  misc_feature: GZ8MTXP01AZOLD.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatacaacagagacgagggaacgtcccccagtatataatagaaagtaagagtgatggcagaccacgaaccggaagggggacggactccccgatcgcttcagtggctccgtagtttcgtggggctcgaccgcctaccgtcccacctactcctacccaacctccagtctagacgagtggaggtctaggagttactcgaacgttggaggaacgagaccgaccaacacgtaagttgagtacgggaacgtaaggggggtacggggtttggggtggtccggggaggggaaccgggaacacggtccgtacggaccccggttacgtacgggtcccgaacggtaaccccggagggtccccgttccggtacccccccgttgggttacccttcccgttccccgtttaaccccggttcccccgtcccccgttcgtccggttacccgtaaacggttccgaaccggg

SEQ ID NO: 347514 - DNA, 616 bp, Homo sapiens
  misc_feature: GZ8MTXP01EYP6X.15.86.H09.1.454.CMB.2.raw
  modified_base (394)..(394): a, c, t, g, unknown or other
  misc_feature (394)..(394): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacaccgaagggggacggatccccgatcgcttcagtgggctcagttcgtgggggctgaccgctacctcccaccatctccaaccctccagtctgacgatgaggctagagtancatggagganagacgccaanaacaagttgaatcgggaccgaagggggtcggggtttggggtacgttcgggacgggaggaaccaaggcgtcggacccgttccgtagggccaacggccccgttaaaggggcccttaccggcccccccgttgggttaccccacctttcccgtcccggtttcccccaaccccgttcccgtcgacccgttaacggttaagtaaccgg

SEQ ID NO: 347515 - DNA, 558 bp, Homo sapiens
  misc_feature: GZ8MTXP01BLFXF.15.86.H09.1.454.CMB.2.raw
  modified_base (389)..(389): a, c, t, g, unknown or other
  misc_feature (389)..(389): n is a, c, g, or t
  modified_base (395)..(395): a, c, t, g, unknown or other
  misc_feature (395)..(395): n is a, c, g, or t
  modified_base (409)..(409): a, c, t, g, unknown or other
  misc_feature (409)..(409): n is a, c, g, or t
  modified_base (520)..(520): a, c, t, g, unknown or other
  misc_feature (520)..(520): n is a, c, g, or t
  modified_base (544)..(544): a, c, t, g, unknown or other
  misc_feature (544)..(544): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtccccagtatataatgaaagttaagagtgatggcagccacaccgaagggggacggatccccgatcgcttcatgggctccagttcgtggggctgaccgctacctccaccatcctccaaccctccagtctgacgatcgaggctgagtancagtgnggagagagcaacanaattgagtggaccgaaggggtacggggttggggtcgttcggggacggagggaccaaggccgtacgacccgtcgtacgggcaacgcccaagggccttcgcccccgtggttcncttctccgtcccaacccttccgcnctaacgttcgaacg

SEQ ID NO: 347516 - DNA, 574 bp, Homo sapiens
  misc_feature: GZ8MTXP01CDT1S.15.86.H09.1.454.CMB.2.raw
  modified_base (335)..(335): a, c, t, g, unknown or other
  misc_feature (335)..(335): n is a, c, g, or t
  modified_base (368)..(368): a, c, t, g, unknown or other
  misc_feature (368)..(368): n is a, c, g, or t
  modified_base (564)..(564): a, c, t, g, unknown or other
  misc_feature (564)..(564): n is a, c, g, or t
  modified_base (569)..(569): a, c, t, g, unknown or other
  misc_feature (569)..(569): n is a, c, g, or t
  modified_base (572)..(574): a, c, t, g, unknown or other
  misc_feature (572)..(574): n is a, c, g, or t
tcagtctacgtagccacgaccggtgctcgatttagtgctatagacttgggtttgggggaagaggaagactgacggtcccttagagtctcctgtgtggcctctggattcactttcagtaatggctggatgagttgggtccgccaggctccagggaaggggctggagtgggttggacgtttcaaaagtaaaaatgatggtgagaaaatagactacggtgcacccgtgaaaggaagattcaccatctcaaagagataaattacaaaaaacgacggtgtatttgacaaaatgaaacagcctagaaaaccgaggacacagccgtctattactgtaaccanagagttcggaagtgacatcggaacgtaaagggnggctatgcttttgatactctgggggcccaggggacaaagtggtcgtcgtctcttcagcctccacacggccatcgtcttcccctggccaccctcctccaagcgcacctcgtggggggggcacgagccgcccgtgggcctgcctggtccaaggcctacttcgcttacgtagacgtgcggcgggcttcgggcaagggcncgtanagnnn

SEQ ID NO: 347517 - DNA, 667 bp, Homo sapiens
  misc_feature: GZ8MTXP01DQK65.15.86.H09.1.454.CMB.2.raw
  modified_base (274)..(274): a, c, t, g, unknown or other
  misc_feature (274)..(274): n is a, c, g, or t
  modified_base (290)..(290): a, c, t, g, unknown or other
  misc_feature (290)..(290): n is a, c, g, or t
  modified_base (459)..(459): a, c, t, g, unknown or other
  misc_feature (459)..(459): n is a, c, g, or t
  modified_base (500)..(500): a, c, t, g, unknown or other
  misc_feature (500)..(500): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctcgagggagggctggngtgggtggtacgttanaaagtaaatgatggagaagaaatagacgtacggtgaccaccgtagaaaggagattacacctatactacaagaagaataattaacaaaaacgtacggtattatttcgactaaatagaaacagaccctaacgaaaccggagaacacgacgaccgtatattactgtaaccanagtacgttacggaaagtgctaagtcggaaacggttaaaggnggtacttagtggttactttttaggaattacgtcggtaccgggggacccaggggaaactagtcggttacgtccgtcctaacttcgacgtcccttaccgaaccggacgggttccccttagttccggttccccttccccgtgcccctacccttcctaacgaaacgtcccg

SEQ ID NO: 347518 - DNA, 615 bp, Homo sapiens
  misc_feature: GZ8MTXP01DER13.15.86.H09.1.454.CMB.2.raw
  modified_base (229)..(229): a, c, t, g, unknown or other
  misc_feature (229)..(229): n is a, c, g, or t
  modified_base (434)..(434): a, c, t, g, unknown or other
  misc_feature (434)..(434): n is a, c, g, or t
  modified_base (535)..(535): a, c, t, g, unknown or other
  misc_feature (535)..(535): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgcgtgggagcctcgatcaagctcacctgcaccctaagtagtgagcatcgaacctacacatcgaatgtatacaanagagacaggacgtccccagtatataatagaaagtaagagtagagtggacacgaccaacgaaccggaagggggacggactccccgatcgcttcgagtgggctcgtagtttcggcggggctcgaccgctacctacccaccactcctacccaacctccacgtcgtagacgagtgacggctagagtatcgagtggaggagagacaccanactaagtgatcggaccgtaagggggtcgggttggggtcgtacggggacggaacggacgagtaccgtcgtacccgtacgaggtcaacgcccgaagggtcccncccggtacccccgtggttacccttcgttccgttccccgtcccccgtccttcccgtacggttacttaaccgggcgtaacgg

SEQ ID NO: 347519 - DNA, 783 bp, Homo sapiens
  misc_feature: GZ8MTXP01DFILW.15.86.H09.1.454.CMB.2.raw
  modified_base (334)..(334): a, c, t, g, unknown or other
  misc_feature (334)..(334): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtataataatagaaagttaagagtgatggcagccacgaccgaagggggacggatccccgatcgcttcagtgggctcgagttcgnggggctcgaccgctacctccaccatctacccaacctccagtctgacgatgagctagagtatcacgtggtaggagaagacgacccaacgaactaaagttggagttacggggaaccccgtaaaggggggttaacccgggggttttgggggttacggtttaccggggggacggggtaaaccgggggtaaccccaaaggggtcccgttacggggtaacccccggtttacccgtaaacgggggttccccaaaccggggtaccccccggaaaagggggttcccccttacccggggtacccccccccccggtttcgggggttaccccgttaaccccggttttccccggttttcccccgggggtttaccccccccccggtccccccttttaacccccggttccccggggttaccccgttttaaaaccccgggggttaaccggttaaaccccccgggg

SEQ ID NO: 347520 - DNA, 583 bp, Homo sapiens
  misc_feature: GZ8MTXP01BP8MN.15.86.H09.1.454.CMB.2.raw
  modified_base (305)..(305): a, c, t, g, unknown or other
  misc_feature (305)..(305): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (543)..(543): a, c, t, g, unknown or other
  misc_feature (543)..(543): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaagggggacggacnccccgatcgcttcagtcgggctccgagtttcgtgggggctcgaccgctacctcccaccactcctacccaaccctccagtctgacgactgaggctggaatctcacgtgaggagagganccanacaattgatcggaccgaaaggggtcgggtttgggggtcgttcggggacggacgggacctaaggcgtcggaaccgtcgttaggccaaggccccaagggcccttcgccccgtggttccncttccgttcgtccccgcctccctcgcctaacgttcgaacg

SEQ ID NO: 347521 - DNA, 633 bp, Homo sapiens
  misc_feature: GZ8MTXP01B9YQF.15.86.H09.1.454.CMB.2.raw
  modified_base (228)..(228): a, c, t, g, unknown or other
  misc_feature (228)..(228): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaanagagaccaggaacgtccccagtatataatagaaagttaagagtgatggcagccacgaccggaagggggacggactcccgatcgcttcagtgggctcgtagttcgtggggctcgaccgctacctccaccatcctacccacctccacgtctagacgagtgagctagatatcagtgaggagagacgaccaatacgaagttcgagtcgggaccgtaaggggggtacggggtttgggggtcgttacgggggacgggaacgggaccgaaggccgtcgacccggttaccgtaacggtccgaaccggacccgaaggggtccccttaccggtaccccccgttagggttaacccttccgttcccggttccccctacccgtccgttaccggcgtttaacggaacgttccgtaaggg

SEQ ID NO: 347522 - DNA, 591 bp, Homo sapiens
  misc_feature: GZ8MTXP01CV6IF.15.86.H09.1.454.CMB.2.raw
  modified_base (341)..(341): a, c, t, g, unknown or other
  misc_feature (341)..(341): n is a, c, g, or t
  modified_base (522)..(522): a, c, t, g, unknown or other
  misc_feature (522)..(522): n is a, c, g, or t
  modified_base (560)..(560): a, c, t, g, unknown or other
  misc_feature (560)..(560): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacgagggaactccccagtatataatagaaagttaagagtgatggcacgaccaacgaccggaaagggggacggacgtccccgatcgcttcgagtcgggctcgtagttcgngggctcgaccgctacctccacctactcctacccacctcagtctagacgagtgagctagagtatcacgtggagacagacgaccaacacgtaagtgagtacggaccgtaaggggtacggggttgggtacgtcgggacggacggaccgagtcgcgtaccgtcgtaggcaacgccgaacggtccnccgaccccgtggttacccttcttccgtcccgtaccccncccgtccgtcgttacctaacggaacgtaacg

SEQ ID NO: 347523 - DNA, 548 bp, Homo sapiens
  misc_feature: GZ8MTXP01AGTOY.15.86.H09.1.454.CMB.2.raw
  modified_base (399)..(399): a, c, t, g, unknown or other
  misc_feature (399)..(399): n is a, c, g, or t
  modified_base (410)..(410): a, c, t, g, unknown or other
  misc_feature (410)..(410): n is a, c, g, or t
  modified_base (503)..(503): a, c, t, g, unknown or other
  misc_feature (503)..(503): n is a, c, g, or t
  modified_base (514)..(514): a, c, t, g, unknown or other
  misc_feature (514)..(514): n is a, c, g, or t
  modified_base (533)..(533): a, c, t, g, unknown or other
  misc_feature (533)..(533): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacggatccccgatcgcttcatgggctcgagttcgtgggggctgaccgctacctccaccatcctccacctccagtctgacgatgagctgagtatcacgtgagganagacgtccaanacaattgaatcggaccgaaggggtacgggttggggtcgttcggggcgggagggacccaaggctcgaccgtcgtaggcaacgcccgaagggccncgcccctggcncttctcgttcccaacctcncgctaacgttgaacg

SEQ ID NO: 347524 - DNA, 581 bp, Homo sapiens
  misc_feature: GZ8MTXP01EXV6K.15.86.H09.1.454.CMB.2.raw
  modified_base (400)..(400): a, c, t, g, unknown or other
  misc_feature (400)..(400): n is a, c, g, or t
  modified_base (421)..(421): a, c, t, g, unknown or other
  misc_feature (421)..(421): n is a, c, g, or t
  modified_base (549)..(549): a, c, t, g, unknown or other
  misc_feature (549)..(549): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatacaacagagaccgagggacgtccccagtatataatagaaagtagagtgatggcagaccacgaccggaagggggacggactccccgatcgctcgagtggctcgagttcgtggggctcgaccgctacctccacctactcctacccaccctaccagtcgtagacgatgagctgagtancagtgagagagacgacctaanactaagtgagtcggaccgaagggggtcggggttggggtgtacggggcggtaacggacaaggcgtcgtaccgtcgtagcaacggcccaagggccttccggccccctgccttccgttcttcccgtacccncccttccggtcgttaccgtaaccgttcgaacg

SEQ ID NO: 347525 - DNA, 743 bp, Homo sapiens
  misc_feature: GZ8MTXP01EK0BG.15.86.H09.1.454.CMB.2.raw
  modified_base (338)..(338): a, c, t, g, unknown or other
  misc_feature (338)..(338): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacacatcgaatggtatcaacagagaccagggaacgtcccccagtatataatagaaagtaagagtgatggcagaccaacaccggaagggggacggactccccgatcgcttcagtcgggctccgagtttcgngggggctcgaccgctacctccacctactcctacccaaccctacccagtcctgaacgagtagaggctagtagtatctaagtggaggaagagacgaccaaacacgaaattggaatacgggaacccggaaagggggttccgggggtttagggggtacgttaccgggggaccgggaaacgggaaccccgtaaaggtaccgttccgggtaaacccccgggttacccgttaaagggggtccccaaaccggtacccccgggaaaacgggggtccccctttaccccggggaccccccccccgtttgggggttaccccttacccgtttccccggtttccccgggtttccccccccgaacccctttccccggtccggttacccgtttaaccgggttaaccgggttaaccccgggg

SEQ ID NO: 347526 - DNA, 638 bp, Homo sapiens
  misc_feature: GZ8MTXP01DWZQG.15.86.H09.1.454.CMB.2.raw
  modified_base (350)..(350): a, c, t, g, unknown or other
  misc_feature (350)..(350): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcataccgaacctacaccatcgaatggtatacaacagagaccgagggaaccgtccccaagtataataatagaaagttaagagtgatggcagaccaacgaaccggaagggggacggactaccccgatcgctcgagtgggtcctcgtagttcgnggggtctcgaccgctacctcccacctactccctaccctaaccctcccacgtcgtagaccgagtgacggtctgagtatactacgtggaggagacggaacaccaacacgtaaagttggattacgggaccgtaaggggggttacggggtttggggtacgtcggggaggacgggactaggacgtcgtaccgtcgtacggtcaacgccgacggccgttccgccccgttcggttccttaccttccgttcccgtacccctaaccctccgtccgaccgttaacgttaacgtaacgg

SEQ ID NO: 347527 - DNA, 594 bp, Homo sapiens
  misc_feature: GZ8MTXP01CCR1J.15.86.H09.1.454.CMB.2.raw
  modified_base (301)..(301): a, c, t, g, unknown or other
  misc_feature (301)..(301): n is a, c, g, or t
  modified_base (347)..(347): a, c, t, g, unknown or other
  misc_feature (347)..(347): n is a, c, g, or t
  modified_base (371)..(371): a, c, t, g, unknown or other
  misc_feature (371)..(371): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacgganccccgatcgcttcatgggctcgagttcgtggggctgaccgctaccnccaccatcctaccacctccagtcngacgatgagctgacgtatcacgtgtcggagagacgccaacactaaagttgaatgggaccaagggggtacggggttggggtcgttcggggacggacggggaccaaggctcgaccgtccgtacggtcgaacgtcccgaagggccttacgcccccgtgggttccttaccgttccgttccgttcccccgccccttccgtccgaccgttaacggttaacgtaacccgg

SEQ ID NO: 347528 - DNA, 634 bp, Homo sapiens
  misc_feature: GZ8MTXP01CSQYC.15.86.H09.1.454.CMB.2.raw
  modified_base (408)..(408): a, c, t, g, unknown or other
  misc_feature (408)..(408): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacacatcgaatggtatcaacagagaccagggaagtcccccagtatataatgaaagttaagagtgatggcagccacaccgaaggggacggatccccgatcgcttcatgggctccagttctggggctgaccgctacctccaccatctccaacctcccagtctagacgatgagctgacgtatcactgtaggagaggacgccaanaaccaattgattgggaccaaagggggtacggtttgggggtagttcggggacgggaaggggaacccaaggtacctcgaacccggttccgttaacggggccaacggcccccgaaaggggtcccttaccgggccccccccttggggttacccgacctttcccgttcccggtttaccccctaaccccgttccccttccgggttacccttaaccgggttaacgggtaaccg

SEQ ID NO: 347529 - DNA, 622 bp, Homo sapiens
  misc_feature: GZ8MTXP01EQ0NZ.15.86.H09.1.454.CMB.2.raw
  modified_base (415)..(415): a, c, t, g, unknown or other
  misc_feature (415)..(415): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgagtggcagccacgaccgaagggggacggactccccgatcgcttcagtggctccgagttcgtggggctgaccgctacctcccaccactcctccaaccctccacgtctagacgagtgaggtctgagtatccagttggaggganaggtacgcccaacgactaaagttggaatcggggaaccctaaaggggggtccggggttttgggggtcgttacccgggggaggggtaccgggaaacctaaggcgttacggacccgttaccgtagggtccaacgaccccgaagggtccttacggcccccctgggttcaccttcgtccgttccccgcccttcgtgccgttaacgaagtccg

SEQ ID NO: 347530 - DNA, 726 bp, Homo sapiens
  misc_feature: GZ8MTXP01EBUHB.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtccccagtatataatagaaagttaagagtgatggcagccacaccgaagggggacggatccccgatcgcttcagtggctcgagttcgtgggctgaccgctacctccaccatcctccaaccctaccagtcgtgacgataggagctgagtatcgactggtaggagagaacgcccaaacaacaaagttgaacgttcgggaaccctaaaggggggtacggggttttggggtacggttacggggacggggtaacgggggaacccaaagggtcccttacgggaaccccggttacccgttaacgggggtccccaaagggtacccccccggaaaagggggtcccccttaccggggtaccccccccccgtttcgggggttaccccttaccccgttccccgtttaaccccgggttttccccccccgtaaacccccttttcccccgttccggggttaccccttttaaaccccgggggttttaaacggtaacccggg

SEQ ID NO: 347531 - DNA, 622 bp, Homo sapiens
  misc_feature: GZ8MTXP01ACBGW.15.86.H09.1.454.CMB.2.raw
  modified_base (271)..(271): a, c, t, g, unknown or other
  misc_feature (271)..(271): n is a, c, g, or t
  modified_base (525)..(525): a, c, t, g, unknown or other
  misc_feature (525)..(525): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacgaggacgtccccagtatataatagaaagtagagtganggcagcacgacgaagggggacggactccccgatcgcttcagtcgggctcgagttcgtcggggctcgaccgctacctccaccactcctcccacctccagtctgacgatgagctagagtatcgacgtggaggagacgacgcctaacgaacaagttgaagtcggaaccgaaggggggttacggggttggggttcgtaccggggacgggagggaaccaaggcgtacggaccgttcgtacggcaacgccgacgggtccncccggtccccccgttaggttcccttaccgttccccgttcccgtaccccctaaccctttcccgtaccggttaccgttaacccggttaagtaacccggg

SEQ ID NO: 347532 - DNA, 806 bp, Homo sapiens
  misc_feature: GZ8MTXP01CZ6J6.15.86.H09.1.454.CMB.2.raw
  modified_base (263)..(263): a, c, t, g, unknown or other
  misc_feature (263)..(263): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaaccctaagtagtgagcactacgaacctacaccatacgaatggtatacaacagacgacgaggacgtaccccagtatataanagaaagttaagagtgagtgacacgaccgaacgaaccggaacgggggacggaccgtacccgtacgtacgtccgtacgtacgtacggtccggtaccgttacggtttacggtcggggtccggtaccgtacccggtaccccgtaccctaacccccctaaccctaccttaccctaaccctaaacccccgtaaccctaccgttccgtacgtaacggtacggtaggtacgggtacggtacgtagtaacgttacgtacggttagggtagggaacgaaacggacgttaacccaaactaaaccgttaaagtagttacgggacggtaacccgggaacgggggtttaaagggggtttcgggggttcgggttaccgggggaacgggggaaccggaaacggaaccggtacggtccggtaacccggtacccggttaacgggccgaaccgggtaacccgttaaccgggccgttccccggtaccccggtcccgttaaccgccttaccggttcccgttccccggtccctacccgtcgttacgtaaccggttaagtaaccgg

SEQ ID NO: 347533 - DNA, 577 bp, Homo sapiens
  misc_feature: GZ8MTXP01EPRG9.15.86.H09.1.454.CMB.2.raw
  modified_base (411)..(411): a, c, t, g, unknown or other
  misc_feature (411)..(411): n is a, c, g, or t
  modified_base (533)..(533): a, c, t, g, unknown or other
  misc_feature (533)..(533): n is a, c, g, or t
  modified_base (557)..(557): a, c, t, g, unknown or other
  misc_feature (557)..(557): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacggatccccgatcgcttcatgggctccagttcgtggggctcgaccgctacctccaccatctacccaacctccagtctgacgatgaggctgagtatcactggtgagagacgccaanacaagttgatggaccctaaaggggtacgggttggggtcgttcggggacgggacgggacccaaggcgtacggtacccgtcgtagggtcaacggcccgaagggccttacgcccccgtggttccncttccgtccgtccccgcccttccncgccgtaacgttcgaaccgg

SEQ ID NO: 347534 - DNA, 696 bp, Homo sapiens
  misc_feature: GZ8MTXP01B1PBG.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatacaacagagaccgagggaacgtccccagtatataatagaaagtaagagtgatggacagaccacgaccggaagggggacggactccccgatcgcttcgagtcggctccgtagttcgtcggggtctcgaccgtctacctcccaccactccctacccaaccctacccagtcgtgacgagtggaggctagagtactcgaacgttggaggaagagacgaccaacaactaagttcgaagtacgggacccgtaaaggggggttcggggtttcggggttcgggtaccgggggacgggtaacggggaacccaagggccgttacggtaaccccggttaccgttaacgggtacccgaaccggaccccggttaacggggtccccttacccgggccccccgttcggttcccttacccgttccgttaaccccgttcccccaaccccgttcccgtccggttaccgttaacggttaacggtaacccgg

SEQ ID NO: 347535 - DNA, 755 bp, Homo sapiens
  misc_feature: GZ8MTXP01ARE61.15.86.H09.1.454.CMB.2.raw
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctcgagggaggggctggagtgggttggacgttacaaaagtaaaatgatggagaagaaatagactacggtgacgacccgtagaaaggaagattacacatactacaagagaataaattacaaaaacgtacgtagtaatttagacaaatacgaaacagaaccctaagaaacccgagaaccaacgacgtaccgtactaacttacctacgtaacccaacgagtaagttacgggaaagtcgacaagtaccggaaacggtaaaggacggtacttaagttcggttactttttagggaacttaacggttccggtaccggggggaccccaaagggggtaactaaacggttcgggggttacccgttccggttcttaacccgtttccgacggtcccccgttaccccgaaaacccgggtaacccggggttcccccttaggttcccccggggttcccctttccccccgtcgggtaccccctacccccgttccctaaccgaaaccgtaacccg

SEQ ID NO: 347536 - DNA, 596 bp, Homo sapiens
  misc_feature: GZ8MTXP01AM5TW.15.86.H09.1.454.CMB.2.raw
  modified_base (544)..(544): a, c, t, g, unknown or other
  misc_feature (544)..(544): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatacaacagagaccgagggaacgtcccccagtatataatagaaagttaagagtgatgcagccacgaccggaagggggacggactccccgatcgctcagtggctccgagttcgtgggctcgaccgctacctccaccatcctacccaacctccagtctgacgagtggagctagagtatcgacgttgggaggagagacgccaataacaagttgagtcggaaccgaagggggtcggggttggggtgttacggggacggtagggaccaggtctcgacccgtcgtggtcaacggcccgagggtcccttcccggccccccttggttccnccgttccttaacgtcccccaacccgttctccggttactaaccgttggaaccg

SEQ ID NO: 347537 - DNA, 556 bp, Homo sapiens
  misc_feature: GZ8MTXP01EGWCV.15.86.H09.1.454.CMB.2.raw
  modified_base (333)..(333): a, c, t, g, unknown or other
  misc_feature (333)..(333): n is a, c, g, or t
  modified_base (358)..(358): a, c, t, g, unknown or other
  misc_feature (358)..(358): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (455)..(455): a, c, t, g, unknown or other
  misc_feature (455)..(455): n is a, c, g, or t
  modified_base (514)..(514): a, c, t, g, unknown or other
  misc_feature (514)..(514): n is a, c, g, or t
  modified_base (536)..(536): a, c, t, g, unknown or other
  misc_feature (536)..(536): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacgaccgaagggggacggactccccgatcgcttcagtgggctcgagttcgnggggctgacgctacctccaccatcnccaacctccagtctgacgatgaggctagagtatnactgnggagagacgccaacacaaattgaagtggaccaaggggtacgggttggggtgttcgggnggagggccaagcctgtaccgtcgtaaggccaagcccgaggccttacggccccctggccncttcctcgtccccaacccttcnccgacctaacgttcgaaccg

SEQ ID NO: 347538 - DNA, 619 bp, Homo sapiens
  misc_feature: GZ8MTXP01BVETZ.15.86.H09.1.454.CMB.2.raw
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (491)..(491): a, c, t, g, unknown or other
  misc_feature (491)..(491): n is a, c, g, or t
  modified_base (587)..(587): a, c, t, g, unknown or other
  misc_feature (587)..(587): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcctagagtctctgtgtgctctgntcnttnagtangctgatgagtggccgcaggctccgagggagggctggagtgggttaggacgtttacgaaaagtaaatgatggtagaacgaaatagacgtacggtgaaccgacccgtaaggaaaggaagtacgttaccaacctatactacgaaagagaacttaaattaacgaaaaacggtcggtagtaatttagactaaatgaacagacctaaggggaaaacgngaaccacgacgccgtataattaactagtacccaagagtacgttcgggaattcggacttagtaccggaaaggttaaagggcggttactaagttcgtnttttaggacttagtccggttgggggaaccccg

SEQ ID NO: 347539 - DNA, 661 bp, Homo sapiens
  misc_feature: GZ8MTXP01BB3LW.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaccggaagggggacggactccccgagtcgcttcagtggctcgagttcgtggggctcgaccgctacctccacctactcctacccaacctccagtctagacgatgaggtctgagtatcgagtggtaggagagacgaccaacaataagttcgagtcggggaaccgaaggggggtacggggtttggggtacggttcgggggacgggtacggggacccaaggtccgtacggtacccgttcggtacggtccaaccgggcccgaaagggtccccttacccggcccccccgttcgggttacccttacccgttcccgttaaccccggtttaccccccaacccgttcccgtaccggttaccttaaccgggttaacgtaacccggg

SEQ ID NO: 347540 - DNA, 659 bp, Homo sapiens
  misc_feature: GZ8MTXP01AWWH7.15.86.H09.1.454.CMB.2.raw
  modified_base (355)..(355): a, c, t, g, unknown or other
  misc_feature (355)..(355): n is a, c, g, or t
  modified_base (655)..(655): a, c, t, g, unknown or other
  misc_feature (655)..(655): n is a, c, g, or t
  modified_base (657)..(657): a, c, t, g, unknown or other
  misc_feature (657)..(657): n is a, c, g, or t
  modified_base (659)..(659): a, c, t, g, unknown or other
  misc_feature (659)..(659): n is a, c, g, or t
tcagtctacgtagccacgaccggtgctcgatttagtgctatagacttgggtttggggggaagaggaagactgacggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcaccgtgaaaggagattcaccatctcaagagataattacaaaaacgcggtgtatttgacaaatgaacagacctagaaaaccgaggacacagcctctattactgtaccacagattcggaagtgcatcgaacgtaaaggnggctatgtcttttgatacgtcgtggggcccagggacaaagtcggtcgtcgtctcttcacgccctccaaccgacgggcccacgttccggtcccttccccccgtcggaccctaccccttccctacccgaaacgaccgtccgtacccgttccggtacggggggggggccaccgacgggcccgggcccgtcggggcctcggcccgttcggtaccgaacgggtacccttccgttaacccggtccttaaccgggtacgaccgtgggtacggccgggggcttcgggcgaacgggccgactagttagngngn

SEQ ID NO: 347541 - DNA, 634 bp, Homo sapiens
  misc_feature: GZ8MTXP01CKT9C.15.86.H09.1.454.CMB.2.raw
  modified_base (336)..(336): a, c, t, g, unknown or other
  misc_feature (336)..(336): n is a, c, g, or t
  modified_base (403)..(403): a, c, t, g, unknown or other
  misc_feature (403)..(403): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacacatcgaatggtatacaacagagaccgaggaacgtccccagtatataatagaaagttaagagtgagtggacagaccacgaacgaagggggacggactccccgatcgctcagtggctccgagtttcgngggggctcgaccgctacctcccaccactcctacccaacctccagtctagacgatggaggctgagtancgaatggacggaagacgacgaccaacaacgtaattcgaagtacggggacccaaagggggttccggggtttagggggtcgttcgggggacgggaacggggaacaggtaccgtcggaacccgttcgacgggtcaacggacccgacgggccttacccggcccccgtggttacccttccgttcctccctttcccccaaccccgtttccgaccgttaccttaaccggttgtaaccg

SEQ ID NO: 347542 - DNA, 522 bp, Homo sapiens
  misc_feature: GZ8MTXP01AILGP.15.86.H09.1.454.CMB.2.raw
  modified_base (407)..(407): a, c, t, g, unknown or other
  misc_feature (407)..(407): n is a, c, g, or t
  modified_base (441)..(441): a, c, t, g, unknown or other
  misc_feature (441)..(441): n is a, c, g, or t
  modified_base (484)..(484): a, c, t, g, unknown or other
  misc_feature (484)..(484): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
  modified_base (513)..(513): a, c, t, g, unknown or other
  misc_feature (513)..(513): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacggatccccgatcgcttcatgggctccagttctggggctgaccgctacctccaccatctcccaacctcccagtctgacgatgaggctgagtatcactgtggagagagcccanacaagttgatgggaccaaggggacgggttggggngttcgggcggagggaccagctgaccgtcaggcaagcccaggcncgcccctgcnttcncgtcccgcctcgtcnctcgttgcg

SEQ ID NO: 347543 - DNA, 628 bp, Homo sapiens
  misc_feature: GZ8MTXP01A42ZF.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagtaagagtgatggcagccacaccggaagggggacggactccccgatcgcttcagtcgggctccgagttcgtgggctcgaccgctacctccaccactcctccaacctccagtctgacgagtgaggctagagtatcgacgtggaggagagacgtccaacacaattgatagggaccaaggggggtacgggttggggtcggttacggggcgggtacggggacccaaggcgtcggtaccccggttcgtacgggaccaacgggcccgaagggtcccttaccggccccccgttgggttcccaccgttccgttaacccggttccccccaaccccgttcccgtaccggacccgttaacgggttccgtaacggg

SEQ ID NO: 347544 - DNA, 868 bp, Homo sapiens
  misc_feature: GZ8MTXP01CHBSK.15.86.H09.1.454.CMB.2.raw
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggaaggggctggagtgggttggacgtttacaaaagtaaaatgatggagaagaaaatagaactaggtcgacaccgtagaaaggaagattacaccatctacaaagaagtaataaattaccgaaaaaacgtacggtagttaatttagaacaaaagtacgaaacaacgaacccgtaaggaaaacccggaggaaacccgaacgaacggtacccgttacttaaacgtttaacctacggttaaacccaacgtaaggtaacgtttaaccggggtaaagttcgggaaccctaaagttaacccgggaaaacgggttaaaaggggagggtacctttaaagttggggtttacgtttttttagggaaatttaacgggttcccgggttacggggggaacccccgaaagggggtaaacccgttaaaggttccgggggtttacccgttccgggtttcccttcccttttaccggacccggttaccccttaccccggaaaaccccgggtaacccgggggttacccccgttaacgggtttcccccggggttccccctttccccccccggttcgggaccccctacccccccttacccgttaaccccgaaacggggtaaccccg

SEQ ID NO: 347545 - DNA, 750 bp, Homo sapiens
  misc_feature: GZ8MTXP01BFSGC.15.86.H09.1.454.CMB.2.raw
  modified_base (304)..(304): a, c, t, g, unknown or other
  misc_feature (304)..(304): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccagtatataatagaaagttaagagtgatggcagaccacgaaccgaagggggacgganccccgatcgcttcagtggctcgagttcgtgggctcgaccgctacctcccaccactcctacccaacctcccagtctcggacgtacgtgacggtctagggtattactccgaagttgggtagggaacggaaggaacgacccaactaacgtaaagttgaaacggttcggggaaaccccggtaaaggggggttaacgggggttttggggggttacggtttacccgggggacggggggtaaacggggaacccctaaaggggtccccgttacgggtaaacccccggttaccggtttaaaggggccccaaacccggggtccccgaaagggggtccccctttccccgggccccccccgtttaaggggttcccccttaccgttccccgtttaacccggttacccccccaacccctttccccgtccgggttactaacccggggtttaacgcccgggg

SEQ ID NO: 347546 - DNA, 630 bp, Homo sapiens
  misc_feature: GZ8MTXP01ATGQ9.15.86.H09.1.454.CMB.2.raw
  modified_base (287)..(287): a, c, t, g, unknown or other
  misc_feature (287)..(287): n is a, c, g, or t
  modified_base (414)..(414): a, c, t, g, unknown or other
  misc_feature (414)..(414): n is a, c, g, or t
  modified_base (447)..(447): a, c, t, g, unknown or other
  misc_feature (447)..(447): n is a, c, g, or t
  modified_base (608)..(608): a, c, t, g, unknown or other
  misc_feature (608)..(608): n is a, c, g, or t
  modified_base (627)..(627): a, c, t, g, unknown or other
  misc_feature (627)..(627): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctccgagggagggctggagtgggtgacgttnaaagtaaatgatggagaagaaaatgactaacggtgccaccgtagaaaggagattcaccatctacaagagaataattacaaaaaacgtcggtgtatttgacaaagtgaaacagaacctagaaacccgngtaacacagtccgtactaattaccagtacccanagatttacgggaaatacatacggaacgtaaaggacgtataagttgtcttttaggaattcgtaccggtgggggaccccaaggggaacctaagttcggggtacctcgtctccgttaacacgcccttacacccgaaagggcccagttccggttccttcccccgngccctaccctcacgaagcnccg

SEQ ID NO: 347547 - DNA, 732 bp, Homo sapiens
  misc_feature: GZ8MTXP01B0DN5.15.86.H09.1.454.CMB.2.raw
  modified_base (358)..(358): a, c, t, g, unknown or other
  misc_feature (358)..(358): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccgagggaggggctggagtggggttgacgttacaaaagtaaaatgatggtagaagaaaatagactacggtgacaccgtagaaaggagatcacatactanaaagagaataattacaaaaaacgtcggtagtatttacgacaaaatgaaacagaaccctaagaaaccgagaaccaacgacgacccgtactattacctagtaacccaacgagagttacggaaagtgacaagtacggaaacggtaaaagggacggtacttaagttgggttacttttttagggaacttaacggtccggtacggggggacccctaagggggtaacctaaggttcggggttccgttcggttccttaaccgtttccaccggtccccttaccgaaaccccggtaacggggttcccccttacggttccccggggttcccttccccccccgttggggaccccctaccccgttcccctaacccgaaacggtcccg

SEQ ID NO: 347548 - DNA, 656 bp, Homo sapiens
  misc_feature: GZ8MTXP01B4QUC.15.86.H09.1.454.CMB.2.raw
  modified_base (425)..(425): a, c, t, g, unknown or other
  misc_feature (425)..(425): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgccccgtctgcatctgccttgctgggagcctccatcaagctcacctgcacctaagtagtgagcatacgaacctacaccatcgaatgtatacaacagagacgaggacgtccccagtatataatagaaagttaagagtagagtggacagaccaacgaacggaagggggacggacgtccccgatcgctcgagtggctcgtagttcgtcggggctcgaccgctacctccaccactcctacccaaccctacacgtctagacgagtgaggcgtagacgttatcgagttggagggaanacggacggtacccaaagaacgtaaagttgaacgtacgggaccgtaaagggggtcggggtttaggggtggtacggggacgggacggaacctaaggcgtacggacccgtcgtaacggccgaacgcccggaaggtcccttaccggtcccccccgtgggttaaccccttccgttcccgttcccgttaccccctaaccctttcccgcggttacccgttaaccggttaagtcccggg

SEQ ID NO: 347549 - DNA, 573 bp, Homo sapiens
  misc_feature: GZ8MTXP01DOESG.15.86.H09.1.454.CMB.2.raw
  modified_base (399)..(399): a, c, t, g, unknown or other
  misc_feature (399)..(399): n is a, c, g, or t
  modified_base (413)..(413): a, c, t, g, unknown or other
  misc_feature (413)..(413): n is a, c, g, or t
  modified_base (529)..(529): a, c, t, g, unknown or other
  misc_feature (529)..(529): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacagggaacgtcccccagtatataatagaaagtaagagtgatggcagccacgaccgaagggggacggatccccgatcgcttcagtgggctccgagttcgtggggctcgaccgctacctccaccatcctccaacctccagtctgacgatgagctgagtatcacgtggngagagtacgccaanacaattgatgggacccaaagggggtacgggttggggtcgtcgggacgggaggacccaaggcctgacccgtcctagggtccaacggcccaagggtcccttcgccccccgtggttccnccttcgtccgtcccccgcccttcctcggccttaacgttaagccg

SEQ ID NO: 347550 - DNA, 714 bp, Homo sapiens
  misc_feature: GZ8MTXP01CATMT.15.86.H09.1.454.CMB.2.raw
  modified_base (440)..(440): a, c, t, g, unknown or other
  misc_feature (440)..(440): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatggtatcaacagagaccgagggaacgtccccagtataataatagaaagttaagagtgatggcacgaccacgaaccggaagggggacggactaccccgatcgcttcagtgggctccgtagttcgtgggctcgaccgctacctccaccactcctacccaaccctaccacgttcgtagaacgtacgtggacggctaggacgttatcgaacgttggacggggaanaacggaacgacccaactaacgtaaagtttggaaacgttcggggaacccgttaaaaggggggggttccgggggttttaggggggtacgttaccggggggacggggtaacggggaacccctaaaggtcccggttacggaaccccgttccggtagggtcccgaacggtaccccgaaaggggtccccttccggaccccccgttggttacccttaccgttccgttcccgtaccccctaacccgttcctacggttaccgttaacggttaacgtaaccggg

SEQ ID NO: 347551 - DNA, 601 bp, Homo sapiens
  misc_feature: GZ8MTXP01EKOL3.15.86.H09.1.454.CMB.2.raw
  modified_base (416)..(416): a, c, t, g, unknown or other
  misc_feature (416)..(416): n is a, c, g, or t
  modified_base (429)..(429): a, c, t, g, unknown or other
  misc_feature (429)..(429): n is a, c, g, or t
  modified_base (575)..(575): a, c, t, g, unknown or other
  misc_feature (575)..(575): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgaggggaggggctggagtgggttgacgtttacaaaagtaaaatgatggtagagaaaatagactacggtgcacccgtgaaaggagattcaccatctacaagagaataattacaaaaacgcggtagtatttgacaaatgaacagacctaagaaccgngacacacgccgtntattacagtacacgagattcgggaatcgacatacgaacgtaaaggagacttatgggtcttttgattagtcgtggggcccagggacatggtctcgtctcttcacgtcccttcgaaccgaacgggcccagttcccggtccttccccgngcccaccccttctaaccgaagaaccg

SEQ ID NO: 347552 - DNA, 550 bp, Homo sapiens
  misc_feature: GZ8MTXP01A0PCD.15.86.H09.1.454.CMB.2.raw
  modified_base (390)..(390): a, c, t, g, unknown or other
  misc_feature (390)..(390): n is a, c, g, or t
  modified_base (410)..(410): a, c, t, g, unknown or other
  misc_feature (410)..(410): n is a, c, g, or t
  modified_base (517)..(517): a, c, t, g, unknown or other
  misc_feature (517)..(517): n is a, c, g, or t
  modified_base (536)..(536): a, c, t, g, unknown or other
  misc_feature (536)..(536): n is a, c, g, or t
  modified_base (548)..(548): a, c, t, g, unknown or other
  misc_feature (548)..(548): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacggatccccgatcgcttcagtgggctccagttcgtggggctgaccgctacctccaccatcctcccaacctccagtctgacgatgaggctgatancactgaggagagacgccaanacaagttgaagtcggaccaaaggggtcgggttggggtgtcgggcggaggaccaagccgtgacccgtctaggtcaacgcccgttaaggccttcggccccctggttccncttctccgtcccaacctcncgactaacgttncg

SEQ ID NO: 347553 - DNA, 725 bp, Homo sapiens
  misc_feature: GZ8MTXP01EN2R2.15.86.H09.1.454.CMB.2.raw
  modified_base (292)..(292): a, c, t, g, unknown or other
  misc_feature (292)..(292): n is a, c, g, or t
  modified_base (701)..(701): a, c, t, g, unknown or other
  misc_feature (701)..(701): n is a, c, g, or t
tcagtctacgtagccacgaccggtgctcgatttagtgctatagacttgggtttggggggaagaggaagactgacagtccccccaggagttcgggctgagctgggttttccttgctgctatcttaaaggtgtccagtgtgaagtgcaggtggtggagtcgtgggggagccgttggtaaagccgtggggggtcccttagagtctcctgtgtggcctctggattcactttcagtaatggctggatgagttcggtccgcaggctcgaggggagggctggagtgggttagacgttanaaaagtaaatgatggtagaagaaatagacgtacggtgacgaccgtaagaaaggaagtattaccaccatactacgaagaagtaattaaacttaacgaaaaaacggtcggttagttaatttaggaaactaaagtacgaaacgtaaacgaccgtaacggaaaacccgacgggaaaccacgtaacgtcccgttacttaacttaccgtacgtaaacccaacgtaaggtagttacgggaaagttgaactaagtaaccggaaagtaaagggcgtacttaagtcggtttacgttttagacgtttagtccgggtacgggggaccctaaaggggtactaaggttcgggttccgtcgtaacctcgttcgaccgttcccacccgaacgaaccggttcccttacgtcccggtccttccccgngaccccttaccgttccaacgaacg

SEQ ID NO: 347554 - DNA, 664 bp, Homo sapiens
  misc_feature: GZ8MTXP01A3HT1.15.86.H09.1.454.CMB.2.raw
  modified_base (253)..(253): a, c, t, g, unknown or other
  misc_feature (253)..(253): n is a, c, g, or t
  modified_base (362)..(362): a, c, t, g, unknown or other
  misc_feature (362)..(362): n is a, c, g, or t
  modified_base (441)..(441): a, c, t, g, unknown or other
  misc_feature (441)..(441): n is a, c, g, or t
  modified_base (450)..(450): a, c, t, g, unknown or other
  misc_feature (450)..(450): n is a, c, g, or t
  modified_base (487)..(487): a, c, t, g, unknown or other
  misc_feature (487)..(487): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccncaggctcgagggagggctggagtgggttgacgttacaaaagtaaatgatggagaagaaatagactacggtgaccaccggtagaaaggaagattacaccatctacaaganaataattacaaaaacgcggtagtatttacgacaaatgaaacagaacctagaaaccgaggaacacagccgtactattacngtaacccanagtattacggaagtgactagtacggaaacgtaaaggnggtacttaagtggttacgttttagacttacgtcggtacgggggaccccaagggggacctaagttcggggtcttccggtctccgttcgacgtccccttaccgaaccggaacgggccccttagttccccggttccccttaccccgtcggcccctaccccttccctaacccgaaagcccg

SEQ ID NO: 347555 - DNA, 738 bp, Homo sapiens
  misc_feature: GZ8MTXP01CZ6PF.15.86.H09.1.454.CMB.2.raw
  modified_base (290)..(290): a, c, t, g, unknown or other
  misc_feature (290)..(290): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtcgtgggggagccttggtaaagccgtgggggtccttagagtctcctgtgtggcctctggattcactttcagtaatggctggatgagttgggtccgcgaggctcgagggagggcgtggagtgggttgacgttanaaaagtaaatgatggagaaagaaaatagaacgtacggtagaccgaacccgtaaggaaaaggaagtacttacaacctatacgtacgaaagaagtaaataaacttaaacgaaaaaacggtacggttagttaatttacgaactaaaagtacgaaacgaacgaaaccgtaaacggaaacccgaggaaacaaccgacgtaccgtactaacttactacgtaaccaagtagtagttacggaaagttgacctaagtacggaaacggttaaaggacgtacttaagttcgggttaacgtttttaggaacttacggtccgggtacggggaccccgtaaaggggtaacctaagttcgggtccgtcgttcttaacttccgaccgtcccaccgtaaccgaacggttcccttcgttcccggtcccctcccccgtgcccctacccttccgtaaccgaagtcccg

SEQ ID NO: 347556 - DNA, 701 bp, Homo sapiens
  misc_feature: GZ8MTXP01BUP57.15.86.H09.1.454.CMB.2.raw
tcagtctacgtagccacgaccggtgctcgatttagtgctatagacttgggtttgggggggacttccctggtctccttctacctactgcccttcattttctccacaggtctctgtgctctgcctgtgctgactcacgccccgtctgcatctgccttgcgtgggagcctcgatcaagctcacctgccaccctaagtagtgagcataccgaacctacaccatcgaatggtatacaacagagacgagggactccccagtatataatagaagtaagagtgatgcagccacgacggaagggggacggactcccgatcgcttcagtcgggctccgtagttcggtgggggtctcggacccgtcctaccctacccaccctacttccctaccctaaccctccctacgtcgtacgaccgataggacggctaggtagttaatcctaggttgggagggaacgaggaacacccgaacaactaaagttggaagttacggggaacccgtaaggggggttacgggggttttgggggtaccggttcgggggaccgggacgggacccaaggtcccgtacggtaccccggtacgttacgggccgaaccgggccccgttaaggggtcccttccccggcccccgttcgggttcccttacccgtttcccgttcccggtccccccgtcccttaccccgtcggttaccgttaaccggcgtaaccgg

SEQ ID NO: 347557 - DNA, 671 bp, Homo sapiens
  misc_feature: GZ8MTXP01DSAPG.15.86.H09.1.454.CMB.2.raw
  modified_base (227)..(227): a, c, t, g, unknown or other
  misc_feature (227)..(227): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatgtatcaanagagaccagggactccccagtatataatagaaagtaagagtgatggcacgccaacgaacggaagggggacggacgtccccgatcgtcttcagtggctcgtagttcgtgggggctcgaccgctacctccaccactcctcccaacctccacgtcacgacgatggaggctaggagtatctacgtggtacggagagaacgccaacactaagttgagtcgggaaccgtaaaggggggtcggggtttaggggttcggtacgggggacgggtaaacgggaaccgaaggtaccgtacggtaccccggttacgtacgggttacccaacggtaaccccgaacggggttcccttcccgggtcccccccgttgggttacccaccgtttccccgttcccgtttacccccaaccccttttcccggaccggttcccgttaacggttaaccggtaaccgg

SEQ ID NO: 347558 - DNA, 592 bp, Homo sapiens
  misc_feature: GZ8MTXP01CXFYF.15.86.H09.1.454.CMB.2.raw
  modified_base (418)..(418): a, c, t, g, unknown or other
  misc_feature (418)..(418): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcaacccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaagggggacggatccccgatcgcttcagtgggctccagttcgtgggggctgaccgctacctcaccccatctaccaacctccaagtctgacgatgaggctgagtatcacgttgaggagagacgaccaanacaaattgatcggaccgaaaggtacggggggtttggggtcgttcggggacgggacgggaacccaaggcctacggacccgtccgtaagggccaaggccccaaggcctccggcccccttcgggtcacccgttcttccggttccccgccccttccgtcgtcgttaccgtgccgtggg

SEQ ID NO: 347559 - DNA, 588 bp, Homo sapiens
  misc_feature: GZ8MTXP01CVP2A.15.86.H09.1.454.CMB.2.raw
  modified_base (324)..(324): a, c, t, g, unknown or other
  misc_feature (324)..(324): n is a, c, g, or t
  modified_base (398)..(398): a, c, t, g, unknown or other
  misc_feature (398)..(398): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacggatccccgatcgcttcatgggctcagttcnggggctgaccgctacctccaccatctccaacctccagtctgacgatgagctgagtatcactgtgagagagccanacaattgatggaccaaggggacgggtttggggtacgttcgggacgggagggacccaaaggcctggtaacccggtcctaagggccgaacgccccgaaagggtcccttacggtcccccccttcggggttacccaccgttccgttaaccggttcccccaaccccttcccgtacgccctaaccggttgaaccgg

SEQ ID NO: 347560 - DNA, 724 bp, Homo sapiens
  misc_feature: GZ8MTXP01EVVT7.15.86.H09.1.454.CMB.2.raw
tcagtctacgtagccacgaccggtgctcgatttagtgctatagacttgggtttggggggaagaggaagactgacggtccccccaggagttcgggctgagctgggttttctttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgccaggctccgagggagggctggagtgggtgacgttacaaaagtaaaatgatggagaagaaatagacgtacggtgaccaccgtagaaaggagtactcacatactacaagagaattaataacgaaaacgtacggtagttatttacgaactaaatacgaaacacgtaaccctaacggaaaccgaggaaacaacgacgtacccgttactacttaacctacgtaaccaacaggtagttacggaaagttcggactaacgtaccggaaaggtaaagggacggtacttagttcggttactttttaggaacttacggtccggtacgggggacccgaaggggtaactaaggttcgggtcgtccgttctcttacgaccgtcccttacccgaaccgtaaccggggttccccttaacggttccccgggttaaccccttcccccgtcggtaccccctacccgttccccgtaacgaaacggcccg

SEQ ID NO: 347561 - DNA, 620 bp, Homo sapiens
  misc_feature: GZ8MTXP01AVCOQ.15.86.H09.1.454.CMB.2.raw
  modified_base (419)..(419): a, c, t, g, unknown or other
  misc_feature (419)..(419): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacaccgaagggggacggatccccgatcgcttcagtgggctcagtttcgtggggctgaccgctacctccaccatctccaacctccagtctagacgatgaggctagagtactcacgtgtagggagagacgaccctaanaacgtagttgagtacggacgaagggggttcggggttggggtcggtacggggacgggaacggaccgagggtcctacggtacccgtacgtacggtccgaaccggacccgacggtcccgttcccggtcccccgttacggttcccttccgttcccgttccccgttcccccgcccttccggtcccgttacgttaaccggaacgtcg

SEQ ID NO: 347562 - DNA, 595 bp, Homo sapiens
  misc_feature: GZ8MTXP01EBM7C.15.86.H09.1.454.CMB.2.raw
  modified_base (330)..(330): a, c, t, g, unknown or other
  misc_feature (330)..(330): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatgtatcaacagagacagggactccccagtatataatagaaagtaagagtgatggcagaccacgacggaagggggacggactccccgatcgcttcagtggctcgtagttcgngggctgccgctacctcccacctactcctacccaccctcccagtctagacgagtgaggctggatatcacgttggaggaagagacgaccaacaactagttgagtacgggaccgtaagggggtacggggtttggggtcggttcggggacgggacggaccgaaggtcgtcggtaccgtcgtacggcaacgtacccgaggcccgttccgccccgtcgttccttacgttcctcccgtccctaacccgtcctcgacgttaacgttcgaacgg

SEQ ID NO: 347563 - DNA, 703 bp, Homo sapiens
  misc_feature: GZ8MTXP01BZ6JL.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcacctaagtagtgagcatacgaacctacaccatcgaatggtatacaacagagacgagggaacgtccccagtataataatagaaagttaagagtgatggacagaccacgaccggaaggggacggactccccgatcgctcagtcggctcgagttcgtgggctacgaccgctacctcccaccatcctacccaacctaccacgtctagaaccgtagtggaaggtctagtaagtacttaccgagtggagggaagaacgaacgacccaaactaacgtaagttacggaagttagggaacccgtaaagggggtacgggggtttggggtacgggttaccggggacggggaagggacccgaaaggcccgttaacgggacccgttaccggttaacggacccgaaccggtacccggaaacgggtcccttacccggtaccccccggttacgggttccccgttacccttcccgttcccggtcccccccggtccctttaaccccgcggttaacccgttaaccgggttaacgtcccggg

SEQ ID NO: 347564 - DNA, 692 bp, Homo sapiens
  misc_feature: GZ8MTXP01DW08N.15.86.H09.1.454.CMB.2.raw
  modified_base (426)..(426): a, c, t, g, unknown or other
  misc_feature (426)..(426): n is a, c, g, or t
  modified_base (442)..(442): a, c, t, g, unknown or other
  misc_feature (442)..(442): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacacatcgaatgtatcaacagagacaggaactccccagtatataatagaaagttaagagtagatggcagaccacgaccggaagggggacggactccccgatcgctcagtgggctcgagttcgtgggggctcgaccgctacctaccacctactacccaccctaaccctacctaacgtcgtagaccgagttcggaggactagggatatccgagttgggnggaagaggacgccganaacgtaagttgaagtcgggaaccgtaaaggggggtttacggggttggggtttcggtaccgggggacggaacggggaccaaaggtccggttacggtaacccggttccgtaacgggtcccgaacggtacccggaaacggggtcccttaacccgtccccccggttggttaacccgccctttccgttaaccccggttcccccctcccgtttaccccgtcgggttaccgttaaccggttaacgggttaacccggg

SEQ ID NO: 347565 - DNA, 745 bp, Homo sapiens
  misc_feature: GZ8MTXP01DECIK.15.86.H09.1.454.CMB.2.raw
  modified_base (667)..(667): a, c, t, g, unknown or other
  misc_feature (667)..(667): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgccaacctaagtagtgagcataccgaacctacaccatacgaatgtatacaacagacgacgacgggaacgtccccagtataataatagaaagtaagagtagagtcggcacgaccaacgaacggaacgggggacggaccgtacccgatcgcttacgagtgggcctcgagtttcgcgggggctcgaccgctacctccacctactccctacccaaccctaccagtcgtacgacgtagtggacggtcgtagtacgtactcgtaacggtgggtacgggaaagacggaacgacccaaacgaacgttaaagttacgaaggttacgggaaaccggtaaacggggggggtttacggggttcggggggttacggttaccgggggacggggtaaaccggggaaccgaacggtccggtaccgtaacccgggttaccgtagggtcccaaccgggtaccccgaggtccccgttccccgggttcccctacgggtttaccccncggtttcccgttaacccggttcccccctaacccggtttccggtaccgttaccgttaaccggggttcgttaacccgggg

SEQ ID NO: 347566 - DNA, 735 bp, Homo sapiens
  misc_feature: GZ8MTXP01C92QN.15.86.H09.1.454.CMB.2.raw
  modified_base (346)..(346): a, c, t, g, unknown or other
  misc_feature (346)..(346): n is a, c, g, or t
  modified_base (398)..(398): a, c, t, g, unknown or other
  misc_feature (398)..(398): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatacaacagagaccgagggaacgtcccccagtataataatagaaagttaagagtgatggcagccacgaaccggaagggggacggactccccgatccgcttcgagtcgggctccgtagtttcgngggggtctcgaccgtctacctcccaccactcctacccaaccctacccagtcngacgagtgaggctagagtactcgacgtggagggagaagacgaccaacaacgtaagttgacgttacgggaaccccgtaaagggggggttacggggtttggggggttacggttaccggggggacggggtaaaccgggggaacccgtaaagggtcccgtaaccgggtaccccggtttacccggtaacgggttcccgaaaccgggaccccgttaaacggggtcccgttaccccggtacccccccgttggggttaccccttaccgttccccgtttcccggttacccccccaacccctttccccggtccgttaccgtttaacccgggttaacggtaacccggg

SEQ ID NO: 347567 - DNA, 612 bp, Homo sapiens
  misc_feature: GZ8MTXP01A5Z1C.15.86.H09.1.454.CMB.2.raw
  modified_base (284)..(284): a, c, t, g, unknown or other
  misc_feature (284)..(284): n is a, c, g, or t
  modified_base (292)..(292): a, c, t, g, unknown or other
  misc_feature (292)..(292): n is a, c, g, or t
  modified_base (314)..(314): a, c, t, g, unknown or other
  misc_feature (314)..(314): n is a, c, g, or t
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
  modified_base (367)..(367): a, c, t, g, unknown or other
  misc_feature (367)..(367): n is a, c, g, or t
  modified_base (389)..(389): a, c, t, g, unknown or other
  misc_feature (389)..(389): n is a, c, g, or t
  modified_base (451)..(451): a, c, t, g, unknown or other
  misc_feature (451)..(451): n is a, c, g, or t
tcagtctacgtagccacgaccggtgctcgatttagtgctatagacttgggtttgggggaagaggaagactgacggtcccccaggagttcgggctgagcgtggtttccgtgacgtgctatcttaaagtgtccagtgtgaagtgcaggtggtggagtctgggggagccttggtaaagccgtggggggtcccttagagtctcctgtgtggcctctggattcactttcagtaatggctggatgagttggtccgcaggctcgagggagggctggagtgggtgacgttanaaagtaangatgagaagaaatgactacggncacgtagaaganatcacatacanaagatataatacgaaacgtgtatattcganaatgaacacgaactaagaacgngaacacgacgtcgtactatactactacagtagtagtagaagtcactacgtacgaaggtaagngtactagtcggttcttagtagtacgtcgtcggaccggacggtacgtacgtcggtcgtcgtcttctcgttacgtaccgttaccgtaccgaccggttccgttccgttcccgttcccgttccccgtcccgtcccgtacccgttacccgtaacccgaacgaaccg

SEQ ID NO: 347568 - DNA, 645 bp, Homo sapiens
  misc_feature: GZ8MTXP01A9OTE.15.86.H09.1.454.CMB.2.raw
  modified_base (305)..(305): a, c, t, g, unknown or other
  misc_feature (305)..(305): n is a, c, g, or t
  modified_base (384)..(384): a, c, t, g, unknown or other
  misc_feature (384)..(384): n is a, c, g, or t
  modified_base (430)..(430): a, c, t, g, unknown or other
  misc_feature (430)..(430): n is a, c, g, or t
  modified_base (557)..(557): a, c, t, g, unknown or other
  misc_feature (557)..(557): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagaccacgaccgaagggggacggacnccccgatcgcttcagtgggctccgtagttcgtggggctcgaccgctacctcccaccactccacccaccctaccacgtcngacgatggacggctagagtatcacgtggtaggagacgacgaccaanactaagttgaagtcgggaaccgaagggggttacggggtttgggggtcggttacggggacggggtaacgggaccctaaaggccgtacgtacccggtacgtacggtccgaacggccccaaggggtcccnccggtacccccccgttgggttcccttaccgttcccgtccggttccccccgcccttcccgtcggttaccttaacggttaacgtaaccgg

SEQ ID NO: 347569 - DNA, 630 bp, Homo sapiens
  misc_feature: GZ8MTXP01DGV69.15.86.H09.1.454.CMB.2.raw
  modified_base (577)..(577): a, c, t, g, unknown or other
  misc_feature (577)..(577): n is a, c, g, or t
  modified_base (598)..(598): a, c, t, g, unknown or other
  misc_feature (598)..(598): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccgagggaacgtcccccagtatataatgaaagttaagagtgatggcagccacaccgaagggggacggactccccgatcgcttcagtcggctcgagtttcgtggggctgacccgctacctcccaccatcctacccaacctccagtctgacgagtgaggctgagtatcgacgtggtcggaagaggaacgacccaacaactaaagttagagtacgggaacccgtaaagggggtacgggggtttggggtacggttcggggacgggtacgggaccgtaaagccgtacggaacccgttcgtaagggtccaacggcccgttaaaggccgttaccgcccccgtggttacccncggttacctccgttacccccncccgttccgccgacgtaacgttaacgaacggg

SEQ ID NO: 347570 - DNA, 728 bp, Homo sapiens
  misc_feature: GZ8MTXP01CGPWA.15.86.H09.1.454.CMB.2.raw
  modified_base (287)..(287): a, c, t, g, unknown or other
  misc_feature (287)..(287): n is a, c, g, or t
  modified_base (675)..(675): a, c, t, g, unknown or other
  misc_feature (675)..(675): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttggtccgcaggctcgagggagggctggagtgggtgacgttanaaagtaaatgatggagaagaaatagactacggtgaccgaccgtagaaaggaagacttacgaacatactacaaagacgtaaataaacttaaacgaaaaacggtacggttagtaatttacgaactaaaagtacgaaacacggtaaacccgtaaacggaaacccggacgggaaacaaccgtaacgtacccgttacttaaacttaccgtacgtaacccgaagtaaggtacgttacgggaaagttcggactaaaggtaccggaaaaccgggttaaagggaggtacttaagttcggtttacgttttagaacttacggtcgggtccggggacccgaaggggtactaagtcggttcgtacctcttctcgcgacccttaccgaccgacgggttcccncggttccccggtccttccccgcgtcccctaacccttcctaacgaacgtaaccg

SEQ ID NO: 347571 - DNA, 677 bp, Homo sapiens
  misc_feature: GZ8MTXP01DYQJP.15.86.H09.1.454.CMB.2.raw
tcagtctacgtagccacgaccggtgctcgatttagtgctatagactcgggtttgggggggacttccctggtctccttctacctactgcccttcattttctccacaggtctctgtgctctgcctgtgctgactcacgcccccgtctgcatctgccttgctgggagcctcgatcaagctcacctgccaccctaagtagtgagcatcgaacctacaccatcgaatgtatcaacagagaccgacgggaacgtcccccaagtataataatagaaagttaagagtgagtggcacgacccaacgaaccggaaacggggggacggacgtccccgatcgcttcgagtcgggcctccgtagttcggtcggggcttcgaccgctacctcccacctactccctacccaaccctacccagtcagacgatggacgcgtagagtactcgacgttgggaggagaacgacgacccaaactaactaaagttcggaacgttacgggaacccgtaagggggggttaaccgggggtttggggtaacgggttccgggggacgggaacggggaccgaaaggtccgtacgggacccgtttcgacggtccgaacggacccgaggtcccttccggtccccgtcggttccttcgttcccgtcccttacccccgaaccttccgacgttcgtaacggttgtaacgg

SEQ ID NO: 347572 - DNA, 837 bp, Homo sapiens
  misc_feature: GZ8MTXP01D262Y.15.86.H09.1.454.CMB.2.raw
tcagtctacgtagccacgaccggtgctcgatttagtgctatagacttgggtttgggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcactacgaacctacaccatcgaatggtatacaacagagaccgagggaacgtccccagtataataatagaaagtaagagtgagtgacagaccacgaccggaagggggacggacgtcccgatcgctcgagtcggtctcgtagttcggtgggggctacgaccgtcctacctacccacctactccctaccctaaaccctccctaacgtcgtacggaaccgtagtacggaacgggtacgttagggtaacgttacctacgtaaccggttagggaacggggaagaaacgggtaacgcccctaaaggaaaccttaaggtttacggaacggtaccggggtaaacccgtaaaggggggggtttccgggggtttttaggggggtaccgttaccgggggggaaccggaaaccgggggtaaccaacggggtacccggtttaccggaaaccccgggtttcccggttaaacggggaccccgtaaacgggcccccggggttaaacggggtcccccgttaccccgggtccccccccggtttacgggttaaccccgttcccggtttaccccgtttccccccggtttaaaccccccccgtcccccgtttaccggttacccggttaaccccggttaaccgggttaaccggtaaccggg

SEQ ID NO: 347573 - DNA, 620 bp, Homo sapiens
  misc_feature: GZ8MTXP01DLXCN.15.86.H09.1.454.CMB.2.raw
  modified_base (488)..(488): a, c, t, g, unknown or other
  misc_feature (488)..(488): n is a, c, g, or t
  modified_base (581)..(581): a, c, t, g, unknown or other
  misc_feature (581)..(581): n is a, c, g, or t
tcagtctacgtagccacgaccggtgctcgatttagtgctatagacttgggtttggggggaagaggaagactgacggtcccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgaggggaaggggctggagtgggttggacgttacaaaagtaaaatgatggtagaagaaaatagactacggtgcaccgtagaaaggagattcaccatctacaagagaataattacaaaaacgacggtagtatttgacaaatgaacagacctaagaaccgaggaacacacgccgtactatactgtaccacgagtacttcgggaaatgctaagtacgaacggttaaaagggngtacttagtgggtactttttgaattgtcgtgggggacccagggacagttggtactcgtcttctcgagtcccttacgaccgaacgggttccccngttcccggtccttccccggcccacccttcctccaagccg

SEQ ID NO: 347574 - DNA, 649 bp, Homo sapiens
  misc_feature: GZ8MTXP01BX8A0.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtataataatagaaagttaagagtgatggcagaccacacgaagggggacggatccccgatcgcttcagtggctcagttcgtgggctgaccgctacctccaccatcctacccaaccctccaagtctagacgagtggaggtctcgagtatcgaactggtgggaagagaacgacctaacacgaattgagttacgggaacccgaagggggtacgggggtttggggttgggttaccgggacggggtaacgggaaccgaaggtccgtacggtaccccgtacgtacggtccgaaccggaccccgaaagggtcccttcggtcccccccgtcgggttcccttaccgttccgttcccgttcccccaaccccgttcccgtccgttaccgttaaccggttaacgtaaccgg

SEQ ID NO: 347575 - DNA, 671 bp, Homo sapiens
  misc_feature: GZ8MTXP01B4IZ2.15.86.H09.1.454.CMB.2.raw
  modified_base (615)..(615): a, c, t, g, unknown or other
  misc_feature (615)..(615): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggactccccagtatataatagaaagtaagagtgatggcagaccacgaaccggaacgggggacggacgtccccgagtcgcttcgagtcgggcctccgtaggtttcgtgggggcctcgacccgctaccctaccacccatccctacccaaccctcccacgtcctagacgagtaggacgggcgtagagttactaccgacgttgggaggaagacggaacgacccaaacgaactaagttgaacgttagggaccccgtaaagggggtacgggggtttggggttacgggttaccggggacgggacggggaacccaaggccgtacggtacccgtccgtagggcaaccggacccgttaacggccgttcccgtcccccgtgggttcccnccgttcccgttcccgtacccccaacccttcccgacgttaccgtaacgttcgaacgg

SEQ ID NO: 347576 - DNA, 654 bp, Homo sapiens
  misc_feature: GZ8MTXP01AI8Y7.15.86.H09.1.454.CMB.2.raw
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaggggctggagtgggttggacgtttcaaaagtaaaatgatggtagaagaaaatagacgtacggtgccacccgtgaaaggaagattcaccatctacaagagaactaaattacaaaaacgtacggtagtatttcgacaaatgaacagacctagaaccgngacanacgccgtntatacngtaccanagattcggaagtgacatcgaacgtaaagaggcttaagtggtctttttagatttaagtcgtgggggtaccccaggggaccaagttcggggtcctcggttccttcgttccacggtccccttaccgaacccgtaacggggttccccttagttcccggggttcccttccccccgtgggcccctaccccgttcctaacccgaaaggcccg

SEQ ID NO: 347577 - DNA, 619 bp, Homo sapiens
  misc_feature: GZ8MTXP01C6CTE.15.86.H09.1.454.CMB.2.raw
  modified_base (444)..(444): a, c, t, g, unknown or other
  misc_feature (444)..(444): n is a, c, g, or t
  modified_base (474)..(474): a, c, t, g, unknown or other
  misc_feature (474)..(474): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtggggttggacgtttacaaaagtaaaatgatggtgagaaaatagactacggtgcaccgtgaaagagattcaccatctacaagagaataaattacaaaaaacgtacggtgtaatttgacaaatgaacagacctagaaaccgagacacagccgtctatactgtaccanagattcggaagtgcatcgaacgtaaagggngactatggtctttgattagtcgtgggggcccaggggacaagtgggtacgtcgtctcttcacgtcccacccgtaccgaaacggggcccttagttcccgggttcccttccccccgtcggcccaccccgttcctcccgaaggaacccg

SEQ ID NO: 347578 - DNA, 690 bp, Homo sapiens
  misc_feature: GZ8MTXP01E1RNN.15.86.H09.1.454.CMB.2.raw
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaacgaagggggacggactcccaatcgcttcagtgggctccgtagttcgtgggggctacgacccgctacctcccaccactcctacccaaccctaccagtctagacgatggaggctagagtatccgagtggtaggagaggaacncccaaanaactaaagttggaacgtacgggaacccgtaaaggggggtacggggtttgggggtcgggttaccgggggacggggtaaacggggaaccccgaaaggtccgtacggtaacccccggttcgttaacgggtaccgaaccggtacccgaaacgggtcccttcccgccccccgttacgggttccttacccggttcccttaacccggttaccccctaaccccgttccccgtcgttacccgttaaacggttaacgtaaccggg

SEQ ID NO: 347579 - DNA, 617 bp, Homo sapiens
  misc_feature: GZ8MTXP01EFBT2.15.86.H09.1.454.CMB.2.raw
  modified_base (337)..(337): a, c, t, g, unknown or other
  misc_feature (337)..(337): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgccaccctaagtagtgagcatcgaacctacaccatcgaatggtatacaacagagaccgagggaactccccagtatataatagaaagttaagagtgatggcagaccacgaccggaagggggacggactccccgatcgcttcagtggctcgagttcgngggctcgaccgctacctcccacctactccctaccctaaccctacccagtctagacgatgaggctagagtactcacgtggaggagagacgaccaacactaagttgaagtcgggaaccgtaaaggggggttcggggtttgggggtacggttacggggacgggaacgggacccaaggtccgtcggacccgttcgtaggccaacgcccgaaggccttccgccccgtggttccttccttccgttcccgttccccaaccgttccgtcgacgttaacggaacgtcgg

SEQ ID NO: 347580 - DNA, 534 bp, Homo sapiens
  misc_feature: GZ8MTXP01B1C5O.15.86.H09.1.454.CMB.2.raw
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
  modified_base (439)..(439): a, c, t, g, unknown or other
  misc_feature (439)..(439): n is a, c, g, or t
  modified_base (493)..(493): a, c, t, g, unknown or other
  misc_feature (493)..(493): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacacgaagggggacggatccccgatcgcttcatgggctcagttcgtggggctgaccgctacctccaccatcctccaacctccagtctgacgatgagctgagtatcactgngganagagccanacaattgatgaccaagggacggttgggtgttcgggnggtagggaccaagctgaccgtctaggtcaagcccaaggccttcgccccctggcnccttctcgttccccaacccttccgcgttcctaacgttgtcg

SEQ ID NO: 347581 - DNA, 762 bp, Homo sapiens
  misc_feature: GZ8MTXP01ED765.15.86.H09.1.454.CMB.2.raw
  modified_base (287)..(287): a, c, t, g, unknown or other
  misc_feature (287)..(287): n is a, c, g, or t
  modified_base (451)..(451): a, c, t, g, unknown or other
  misc_feature (451)..(451): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagcgtggtttcctgctgctatcttaaaggtgtccagtgtgaagtgcgaggtggtggagtcgtgggggagccgttaggtaaagccgtgggggtcccttaggatctcctgtgtggcctctgattcactttcagtaanggctggatgaggttcgggtccgccgaggctccggaggggaaggggctgggagtggggttagaccgtttagaaaaagtaaaagtgagtaggtagaaagaaaatagaacgtacggtagaaccgtaacccgtaaggaaaagaaagtattaccaacctagtacctaanaagaagtaataaagttaacgaaaaaaaccggtagggttaagttaagtttacgaacgtaaaagttacgaaaactaacggtaaccccgttaaaggggaaaaaaccccggtaggggaaacccaaaccggtaacgggtaccccgttacttaaactttaaccgtacggttaacccaaaccgtagtaaacgtttaaccggaaaaggttcggaaccttaagtaacccgggtaaaacggttaaacgggttgggttaaccctttaagttacggttttaacgtttacgtacgttacggtccgggttaaccggggtaacccg

SEQ ID NO: 347582 - DNA, 626 bp, Homo sapiens
  misc_feature: GZ8MTXP01C2L73.15.86.H09.1.454.CMB.2.raw
  modified_base (337)..(337): a, c, t, g, unknown or other
  misc_feature (337)..(337): n is a, c, g, or t
  modified_base (355)..(355): a, c, t, g, unknown or other
  misc_feature (355)..(355): n is a, c, g, or t
  modified_base (542)..(542): a, c, t, g, unknown or other
  misc_feature (542)..(542): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaccgaagggggacggactccccgatcgcttcagtgggctccgagtttcgngggggctgaccgctaccncccaccactctcccaacctacccagtctgacgagtagagctgagtatacacgtgtggagagagtaccaacacaagttgagtacgggacccgaaaggggtcggggttggggttacggttcggggcggggaagggaccaaaggtcgtcggtacccgtcgtacgggtcgaaccggcccgaaacgggtccncccggtccccccgtcgggtttacccaccgtttccttcccgttaccccgtccccttcccgtccgacgtaaccgttcggtaaccgg

SEQ ID NO: 347583 - DNA, 641 bp, Homo sapiens
  misc_feature: GZ8MTXP01AJZNV.15.86.H09.1.454.CMB.2.raw
  modified_base (289)..(289): a, c, t, g, unknown or other
  misc_feature (289)..(289): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaanggctggatgagttggtccgcaggctcgagggagggctggagtgggtgacgtttacaaaagtaaatgatggtagaacgaaatagactacggtgacaccgtgaaaggaagattcacgatactcaaagagaataattacgaaaaaccggtggtatagtttagacaaatacgaaacagacctaggaaaacccgaggacaacgacggtccctatacttaacgtcgttaaaccccaagtaagacgtttaacgggaaagttcgaaccgaacgtttacgggaaaacggttaaaggggttggttaccttaagttagtccgtttttaggaagtttaccgtcggttaaccggggggaaccccg

SEQ ID NO: 347584 - DNA, 620 bp, Homo sapiens
  misc_feature: GZ8MTXP01BBDVM.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccgagggaacgtcccccagtatataatagaaagttaagagtgatggcagccacgaccgaagggggacggactccccgatcgcttcagtcgggctcgtagttcgtgggctcgaccgctacctccaccatcctacccaacctccagtctgacgatgaggctgagtactcacgtggtaggagagacgccaacaacgtattgagtcgggaccgaagggggtacggggtttggggtcgttacggggacggtaacggggaaccaaggtcgtacggtaacccgtcgttacgggcaacggcccgaagggtccttccgggcccccttgggttccaccgttcccgtcccgtttccccaacccgttccgtcgttaccgttaacggttaacgtaaccgg

SEQ ID NO: 347585 - DNA, 735 bp, Homo sapiens
  misc_feature: GZ8MTXP01ES0T6.15.86.H09.1.454.CMB.2.raw
  modified_base (227)..(227): a, c, t, g, unknown or other
  misc_feature (227)..(227): n is a, c, g, or t
  modified_base (256)..(256): a, c, t, g, unknown or other
  misc_feature (256)..(256): n is a, c, g, or t
  modified_base (267)..(267): a, c, t, g, unknown or other
  misc_feature (267)..(267): n is a, c, g, or t
  modified_base (269)..(270): a, c, t, g, unknown or other
  misc_feature (269)..(270): n is a, c, g, or t
  modified_base (272)..(272): a, c, t, g, unknown or other
  misc_feature (272)..(272): n is a, c, g, or t
  modified_base (274)..(274): a, c, t, g, unknown or other
  misc_feature (274)..(274): n is a, c, g, or t
  modified_base (304)..(304): a, c, t, g, unknown or other
  misc_feature (304)..(304): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcactacgaacctacacatacgaagtagtancacagacgacgagggacctcccagtatanatagaagtagngnngngnacgcacacggaaggggcgtactccgagtcnctgagcggtctcgtacgttggtcgggctcgaccgtcacctcccaacctacttcccaccctaaacccgttcccgaatttcccgtaggtaaaccgggtacgtaggtacggtacgtagtacgtacgtacgtacggtacgggtaggtaggacggacgaccgaacgtaacgtaacgttacggtaacggtacggtaacgggtaacgggggttacgggggtttacgggggttacggggtacggggtaccggggtaaccgggaaccgtaacggtacggtaccggtaccggtaccggtaccggtaccggtaaccggtacccgggttaccggtacccggttcccggttccccggttacccggttacccgttcccgttcccgttccccgttaccccgtaaccccgtcccgtccggttaccgttaaccggttaaccggtaacg

SEQ ID NO: 347586 - DNA, 606 bp, Homo sapiens
  misc_feature: GZ8MTXP01B5434.15.86.H09.1.454.CMB.2.raw
  modified_base (333)..(333): a, c, t, g, unknown or other
  misc_feature (333)..(333): n is a, c, g, or t
  modified_base (421)..(421): a, c, t, g, unknown or other
  misc_feature (421)..(421): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaccgaagggggacggatccccgatcgcttcagtgggctccagttcgnggggctcgaccgctacctcccaccatcctcccaaccctcccagtctagacgagtgaggctgatactcacgtggtggagagacgccaanacaattgatcgggacctaagggggtcgggtttggggtcgttacggggcgggagggacccaaggtcctcgggtacccgtctagggccaacggccccaaggggcccttcggcccccctgggttccaccgttccgttccgttccccccaacccgttcccgtccgttaccttaaccggttcgtaaccgg

SEQ ID NO: 347587 - DNA, 603 bp, Homo sapiens
  misc_feature: GZ8MTXP01AXO8U.15.86.H09.1.454.CMB.2.raw
  modified_base (476)..(476): a, c, t, g, unknown or other
  misc_feature (476)..(476): n is a, c, g, or t
  modified_base (549)..(549): a, c, t, g, unknown or other
  misc_feature (549)..(549): n is a, c, g, or t
  modified_base (586)..(586): a, c, t, g, unknown or other
  misc_feature (586)..(586): n is a, c, g, or t
tcagtctacgtagccacgaccggtgctcgatttagtgctatagacttgggtttggggggaagaggaagactgacagtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctcgagggagggctggagtgggttgacgtttacaaaagtaaaatgatggtagaagaaaatagactacggtgcacccgtagaaaggagattcaccatctacaagagataaattacaaaaacgtcggtagtactttgactaaatgaacaagaccctaagaaaacccgagggaaccacgagccgtataattacctgtaaccacagattcggaaatgactancgaagtaaaggagctaagtgtctttagatagtcgtcggggacccaggggactaagtcgtcgtcgtctcttacncgccctacacgaacgggcccagtccgtccttccccgngccaccctcaacgaacg

SEQ ID NO: 347588 - DNA, 546 bp, Homo sapiens
  misc_feature: GZ8MTXP01EV1Q8.15.86.H09.1.454.CMB.2.raw
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
  modified_base (389)..(389): a, c, t, g, unknown or other
  misc_feature (389)..(389): n is a, c, g, or t
  modified_base (403)..(403): a, c, t, g, unknown or other
  misc_feature (403)..(403): n is a, c, g, or t
  modified_base (414)..(414): a, c, t, g, unknown or other
  misc_feature (414)..(414): n is a, c, g, or t
  modified_base (418)..(419): a, c, t, g, unknown or other
  misc_feature (418)..(419): n is a, c, g, or t
  modified_base (422)..(422): a, c, t, g, unknown or other
  misc_feature (422)..(422): n is a, c, g, or t
  modified_base (437)..(437): a, c, t, g, unknown or other
  misc_feature (437)..(437): n is a, c, g, or t
  modified_base (447)..(447): a, c, t, g, unknown or other
  misc_feature (447)..(447): n is a, c, g, or t
  modified_base (459)..(459): a, c, t, g, unknown or other
  misc_feature (459)..(459): n is a, c, g, or t
  modified_base (465)..(465): a, c, t, g, unknown or other
  misc_feature (465)..(465): n is a, c, g, or t
  modified_base (470)..(470): a, c, t, g, unknown or other
  misc_feature (470)..(470): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccgttggtaagccgtgggggtcctagagtctctgtgtgctctgatcacttcatangntgatgagtggcgcaggctcgaggagggcnggagtgggtgacgttanaaaagtaaangatggagaacgaaatagactaggtcacaccgtgaaagagatcacatcacaaganataatacaaaacgngtagtattganaaannaanacgactaggaaacgnggaacacganccgtatattacngtaacncagtntaacggattgcttagacgtaacgttaaaggcggttactaagtcgtaacttttgagttactcggttcggggaacccg

SEQ ID NO: 347589 - DNA, 572 bp, Homo sapiens
  misc_feature: GZ8MTXP01A6BOM.15.86.H09.1.454.CMB.2.raw
  modified_base (335)..(335): a, c, t, g, unknown or other
  misc_feature (335)..(335): n is a, c, g, or t
  modified_base (395)..(395): a, c, t, g, unknown or other
  misc_feature (395)..(395): n is a, c, g, or t
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
  modified_base (546)..(546): a, c, t, g, unknown or other
  misc_feature (546)..(546): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatacaacagagaccgagggaacgtccccccagtatataatagaaagttaagagtgatggcagccacaccgagggggacggacgtccccgatcgctcagtggctcgagttcgnggggctgaccgctacctccaccatcctccaaccctccagtctagacatgaggctaggatntacgattggagaccgagacnccctaaanatagtgagcgacgagggggtcggttgggcggtacgggacggacgactagcgtacgtccgtcgtacggcaaccgaccgacggcccttcccgccccgtgttcccttccgttcctccccgtccccncccgtccgcgttacgtaacggcgtcg

SEQ ID NO: 347590 - DNA, 797 bp, Homo sapiens
  misc_feature: GZ8MTXP01EIJLR.15.86.H09.1.454.CMB.2.raw
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtcgtggggggagccttggtaaagccgtggggggtcccttagagtctcctgtgtggctctggattcactttcagtaatggctggatggagttgggtccgcgaggctcgaggggaagggctgggagtggggttagtacgttacaaaagtaaaatgatggtagaagaaaatagactacggtgacgaacccgtagaaaggaagattacacatctacaaagagtaataaataacaaaaacgtacggtagttaactttagaacaaaatacggaaacaacggaaccctaaacgaaaccggaggaaacccaacgaaccgtaccggttaacttaactttaaccgtacgttaaacccgaaacgtaggtaaacgtttaaccgggaaagttacgaaccgtaaggttaaccggaaaacgggttaaaagggacgtacgttaagttagggttacgtttttagggaaacttacggtacggttaccgggggacccgtaaagggtaaaccgtaaggttcggggtcgttccggttacttccgtttcgaaccgtaccccttaccccgaaaccgtaaacccgggccccttaacggttcccggtaacccctttcccccgttcggccccctaccccttacccgtaacccgaacggtaaccccg

SEQ ID NO: 347591 - DNA, 562 bp, Homo sapiens
  misc_feature: GZ8MTXP01CNPTL.15.86.H09.1.454.CMB.2.raw
  modified_base (335)..(335): a, c, t, g, unknown or other
  misc_feature (335)..(335): n is a, c, g, or t
  modified_base (412)..(412): a, c, t, g, unknown or other
  misc_feature (412)..(412): n is a, c, g, or t
  modified_base (419)..(419): a, c, t, g, unknown or other
  misc_feature (419)..(419): n is a, c, g, or t
  modified_base (527)..(527): a, c, t, g, unknown or other
  misc_feature (527)..(527): n is a, c, g, or t
  modified_base (543)..(543): a, c, t, g, unknown or other
  misc_feature (543)..(543): n is a, c, g, or t
  modified_base (559)..(559): a, c, t, g, unknown or other
  misc_feature (559)..(559): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgccccgtctgcatctgccttgctgggagcctcgatcaagctcacctgcacctaagtagtgagcatcgaacctacacatcgaatggtatcaacagagaccgagggaacgtccccaagtatataatagaaagtaagagtgatgcagccaacgacgaagggggacggacgtccccgatccgcttcgagtcgggctcgagttcgngggctgaccgctacctcccaccatctaccaacctccagtctgacgatgagctagagtatcagtggaggaagagtacnccaacanaagttgagtaggaccgaaggggtacgggttgggtcgtcggggacggacggaccagccgtgaccgtcgtaaggcaacggcccgaggtcccttccgccccgtggttcccncttccgtcccgtcccncctacgcgactaacgngcg

SEQ ID NO: 347592 - DNA, 684 bp, Homo sapiens
  misc_feature: GZ8MTXP01BDN97.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacgagggaacgtccccagtatataatagaaagttaagagtgagtggacagaccaacgaccggaagggggacggactccccgatcgtctcagtggctcgtaagttcgtgggctcgaccgctacctccaccactcctacccacctccagtctagacgatgagtctagagtatcgtacgtggtaggaagagaaccgccaaagactaagttgaacgtcgggacccgtaagggggttacggggtttgggggtccggttacgggggacggggtaacgggacctaaagggtccgtacggtaaccccggttaccgtagggtcccgaacggaccccggaacgggtcccttaccccgggccccccgttagggttccccttacccggtttcccgtccccggtttacccccaacccccgtttcccggtaacgttacccgttaacccggttaagggtaaccccgg

SEQ ID NO: 347593 - DNA, 727 bp, Homo sapiens
  misc_feature: GZ8MTXP01CDRU6.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacgaccggaagggggacggactccccgatcgcttcatgggctccgtagttcgtgggggctcgaccgctacctcccaccatcctacccaacctacccagtcgtgaaccgtagtcgagggtctagacgttactcgaacgttgggtaggaagaggacgacccaacgaacgtaagtttagaacgttcgggaacccggtaaagggggtacggggtttgggggtacggttaccgggggacgggtaacggggaacccgaaagggtcccgtacggtaaccccggttaccggtttaacggtacccggaaaccgggtacccccgttaaaggggcccccgtttcggtaccccccccccgttggggttaccccttacccgtttacccgttccccggtttacccccaacccccgtttcccgtaccccggttaccgttaaaccggttcggtaacccggg

SEQ ID NO: 347594 - DNA, 727 bp, Homo sapiens
  misc_feature: GZ8MTXP01EIG41.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtataataatagaaagttaagagtgatggacagaccacgaccggaagggggacggactccccgagtccgcttcagtggctccgagttcgtggggctgaccgctaccgtccaccactccgtacccaaccctacccagtctacgaccgtagtacgacgggcttaggaagttactacgaacgttggacggagagacgaccaacaactaagttgagttacggacccgtaaagggggtacgggtttgggggttacgttcggggacgggtaaccgggtaaccgaacgggtcgttaacccggtaacccggttcccgttaaaggggaccccaaacgggttcccccggaaaggggtccccgtttacccggaccccccccggttaaggggtttccccaacccgttttcccggttccccgttttcccccccgggccccttttaaccgccccggggttaacccttaacggtttaaccggtaacccgggg

SEQ ID NO: 347595 - DNA, 682 bp, Homo sapiens
  misc_feature: GZ8MTXP01AVEYU.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggacgtcccccagtatataatagaaagttaagagtgatggcagccacgaccgaagggggacggactccccgatcgcttcagtggctcgagttcgtggggctcgaccgctacctcccaccactcctacccaaccctcccacgtctagaccgagtggaggtactgagtatccaagttgggtagggaacgaggaaccgcccaactaactaaagttcggattacgggacccgaaagggggttccgggggtttggggtcgggttccggggacggggaagggaccccgaaggtcccgtcggtaaccccgtccgtaaacgggtccgaaccggaccccgaaggggcccttcccggtccccccccgttgggttaccccttaccgttcccgttccccggttccccccgaacccctttccccgccggttaccgttaaccgggttaacggtaaccgg

SEQ ID NO: 347596 - DNA, 578 bp, Homo sapiens
  misc_feature: GZ8MTXP01DT9X7.15.86.H09.1.454.CMB.2.raw
  modified_base (560)..(560): a, c, t, g, unknown or other
  misc_feature (560)..(560): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagacagggaagtcccccagtatataatgaaagttaagagtgatggcagaccacaccgaagggggacggatccccgatcgcttcatgggctcagttctggggctgaccgctacctcaccatctccaacctccagtctgacgaatgagctgagtatcactgtggagagagcccaatacaaattgagtagggcccaaagggggtaccggggtttggggtacggttcggggaccggaagggggacccaaaggccttggaacccgtcctaaggggtcaaggccccgaaagggccttacgcccccgtcggttcaccgttcttcgttccccgccttccncgccttaacgttcgaacg

SEQ ID NO: 347597 - DNA, 687 bp, Homo sapiens
  misc_feature: GZ8MTXP01DX4RK.15.86.H09.1.454.CMB.2.raw
  modified_base (339)..(339): a, c, t, g, unknown or other
  misc_feature (339)..(339): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccaagtataataatagaaagttaagagtgatggcagccacgaccgaagggggacggactccccgatcgctcagtgggctccgaggtttcgngggggctcgaccgctaccctccaccatcctacccaaccctccagtctgacgatcgaggctggatctcaacgtggagggagaagacgacccaactaacaaattcgagttacgggacccgtaaaggggggtacggggtttgggggttacggtttcccgggggacggggaacggggacccgaaaggtcccgttacggggtaaccccggttccggttaaacggggtcccgaacggccccggaaagggtcccgttacccggtcccccccggttcgggttacccttacccggttccttcccggtttaccccctaaccccttcccgtcccggttacttaacccgaacggtaaccg

SEQ ID NO: 347598 - DNA, 655 bp, Homo sapiens
  misc_feature: GZ8MTXP01CYK5D.15.86.H09.1.454.CMB.2.raw
tcagtctacgtagccacgaccggtgctcgatttagtgctatagacttgggtttgggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacacatcgaatggtatacaacagagaccgagggaacgtccccagtatataatagtaaagtaagagtgagtggcagaccaacgaaccggaagggggacggactccccgatcgtctcagtcggctcgtagttcgtgggctagaccgctacctccaccatcctacccacctccagtctacgacgatgagctaggatactcgagtggagaagagacgaccaataacaagttcgaagttcgggaacccgtaaggggggttaccggggtttgggggtacgggttaccgggggacggggtaacggtaccgtaaaggccggtacggtacccggtacgtacgggtccgaacggccccgaaagggggtcccttaccggtcccccggtggttaccacccttccgttaacccgtccccctaaccgttcccgcgttacccgtcggttaacgtaaccggg

SEQ ID NO: 347599 - DNA, 595 bp, Homo sapiens
  misc_feature: GZ8MTXP01AK4OH.15.86.H09.1.454.CMB.2.raw
  modified_base (437)..(437): a, c, t, g, unknown or other
  misc_feature (437)..(437): n is a, c, g, or t
  modified_base (475)..(475): a, c, t, g, unknown or other
  misc_feature (475)..(475): n is a, c, g, or t
  modified_base (480)..(480): a, c, t, g, unknown or other
  misc_feature (480)..(480): n is a, c, g, or t
  modified_base (497)..(497): a, c, t, g, unknown or other
  misc_feature (497)..(497): n is a, c, g, or t
  modified_base (547)..(547): a, c, t, g, unknown or other
  misc_feature (547)..(547): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaggggctggagtgggttggacgtttacaaaagtaaaatgatggtgagaaatagactacggtgcaccgtgaaaggagattcaccatctacaagagaataattacaaaaacgtacggtagtatttagactaaatagaacagaacctagaaccgagacacagccgtctattacngtaccacagattacggaagtgacatcgaacgtaaaggngctanggtactttgatagtcgngggcccaggacagtggtcgtcgtctctcacgcccttcaaccgagggcccngttcccggttccctccccgtggcccacccttcctaaccgaagtaaccg

SEQ ID NO: 347600 - DNA, 708 bp, Homo sapiens
  misc_feature: GZ8MTXP01CT0CD.15.86.H09.1.454.CMB.2.raw
  modified_base (338)..(338): a, c, t, g, unknown or other
  misc_feature (338)..(338): n is a, c, g, or t
  modified_base (429)..(429): a, c, t, g, unknown or other
  misc_feature (429)..(429): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatacgaacctacaccatcgaatggtatacaacagagacgaggacgtccccagtatataatagaaagttaagagtgatggacagaccacgaccggaagggggacggacgtccccgatcgctcagtcggctccgagttcgngggctcgaccgctacctcccaccactcctacccacctccagtctgacgagtgagctagagtatcgagtggaggaacgtagacgtacccaanaactaaagttggaaacgtcgggaaccgtaaaggggggttcgggggtttgggggttacgggttaccccgggggagggggaaacccggggacctaaaggtcccgggtacggtaacccccggttggtaaaccggggtccaaaccggggccccgttaaaggggtcccttccccgggtaccccccggttcgggttccccgttacccgttcccggtttcccccgttaccccccccgtccccgttccccgttccggaacccgtttaaccgggaacggtaacccggg

SEQ ID NO: 347601 - DNA, 813 bp, Homo sapiens
  misc_feature: GZ8MTXP01ARUQE.15.86.H09.1.454.CMB.2.raw
  modified_base (288)..(288): a, c, t, g, unknown or other
  misc_feature (288)..(288): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcagggtggtggagtctgggggagccttggtaaagccgtggggggtcccttagagtctcctgtgtggcctctggattcactttcagtaatggctggatgagttggtccgcaggctcgagggagggctggagtgggtgacgttanaaaagtaaatgatggtagaagaaatagactacggtgcaaccgtagaaaggagacttcaaccatactacgaaagagtaaataaacttaacgaaaaaacggtacggttagtaacttttacgaacctaaaagtacgaaactaacggaaacccgtaaacgggaaacccgagggaaaccaacgtaacggtcccgttaacttaaagtttaaacctcgttaaacccaacgtaagtaacggtttaccgggaaaagtcggaaccgtaagttaacccgggaaaacggttaaaacggggacgggttacctttaaggttacggggtttacttttttaaggggaactttaaccggttccgggtaccggggggaccccgtaaggggtaacctaagggttcgggtaccgtttcgttcccttaacgttccgacggtacccccgttaccgaaacccggaaccggggttccccttacggttccccggttcccttcccccgtcgggacccctaccccgttacccgtaaccgaaacggtccccgg

SEQ ID NO: 347602 - DNA, 674 bp, Homo sapiens
  misc_feature: GZ8MTXP01EZHOP.15.86.H09.1.454.CMB.2.raw
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
  modified_base (334)..(334): a, c, t, g, unknown or other
  misc_feature (334)..(334): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcagggtggtggagtcgtggggggagccttgggtaaagccgtggggggtcccttagagtctcctgtgtggcctctggattcactttcagtaatggctggatgagttgggtccgccaggctccgaggggagggcgtggagtggggttggacgtttanaaaagtaaaangatggagaagaaatagactaggncaccgtagaaagagatcacatctacaagataataattacaaaaacgtacggtagttatttagacaaatgaacagaaccaagaaacccgagaacacgacgccgttactattactacgtaacccaagtaaggtacgttacgggaaagttcgactaagtaccggtaaacgggtaaagggaggtacttagtggggtttctttttaggaattacgtccggtacggggccctaaggggacctaggtggtccgttcgtctcttcgacgtcccttaccgaccgaacgggccccttagttcccggtccccttccccgtcggccctaccccgttctaacccgaagaaccg

SEQ ID NO: 347603 - DNA, 640 bp, Homo sapiens
  misc_feature: GZ8MTXP01EG92S.15.86.H09.1.454.CMB.2.raw
  modified_base (495)..(495): a, c, t, g, unknown or other
  misc_feature (495)..(495): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgaggggaaggggctgggagtggggttggacgtttacaaaagtaaaatgaatggagaagaaaatagactacggtgcaccgtagaaaggagattcaccatctacaagagaataaattacaaaaacgacggtagtatttacgacaaatagaaacagaaccctaagaaaccgaggaacacacgccgttactattactgtaaccacagattcggaagtgacatacggaacggtaaaggnggtactagtggtcttttaggattagtcgtcggggacccagggactaagtggtccgtcgtctcttcacgtcccttccgaaccgtaacgggccccttagttcccggttcccctccccgtcgccctaccccttcctaaccgaacgccg

SEQ ID NO: 347604 - DNA, 588 bp, Homo sapiens
  misc_feature: GZ8MTXP01BD6RH.15.86.H09.1.454.CMB.2.raw
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgatgggagcctcgatcaagctcacctgcaccctaagtagtgagcatcgaacctacaccatcgaatggtatcaacagagaccagggaagtcccccagtatataatgaaagttaagagtgatggcagcaacaccaagggggacggatccccgatcgcttcatgggctccagttctgggggctgaccgctacctcaccatctccaacctccatctgacgatgagctgagtatnatgngagagagacacaacaatagagtagacgaaggggtacgggttaggggttgggttcgggcgggacgggaccgaacgacgtcggtaccgtaccgtacggtacgaacgacccgaacggaccgttccgtccccgtcccggttccgttccttccgttccgttcccctaaccccgtcccgtccgttaccgtaaccgttaacgtaacg

SEQ ID NO: 347605 - DNA, 839 bp, Homo sapiens
  misc_feature: GZ8MTXP01DU7J8.15.86.H09.1.454.CMB.2.raw
tcagtctacgtagccacgaccggtgctcgatttagtgctatagacttgggtttgggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggaagggctggagtgggtggatgttacaaaagtaaaatgataggtagaagaaatagacgtacggtgacacccggtagaaaggaagtattccaacctatctacaaagtaagaattaaattaaccaaaaaacggtcggttagttaatttacgactaaaagtgaaacaaacgacctaacggaaaaacccgagggaaacaacgacgtacccgttacgtaaactttactacgtaaccaacacggtaacgttacggggaaagtcgtacgaaacgtaccgggtaaaacggtaaaggggacgggtacctttaagggttcggtttccgttttttaggaacgtttaaggttcccgggttacgggggacccccgtaaagggggtaaccctaaaggttcggggttacccgtttcgggttcctttccgtttaccggaaaccccggttccccttaaccccggaaaacccgggttaaaccccgggggttcccccttaaccgggttttcccccggggttcccccttttccccccccgggttcgggaccccccttacccccgttaacccccgttaaccccgaaaaccggg

SEQ ID NO: 347606 - DNA, 695 bp, Homo sapiens
  misc_feature: GZ8MTXP01CP1VT.15.86.H09.1.454.CMB.2.raw
  modified_base (287)..(287): a, c, t, g, unknown or other
  misc_feature (287)..(287): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttggtccgcaggctcgagggagggctggagtgggtgacgttanaaaagtaaatgataggagaagaaatagactacggtgacaccgtagaaaggaagattcacctatctacaagaagtaataaattaacaaaaacggtacggtagttatttacgactaaatagaaacacgaacctaacgaaaccgagaacacagaccgtacttatacacgtaaccaacgtagtacgttacggaaagtcgaactacgtacggaaacggttaaaggaggtacttagttggttactttttagattacgtccggtacggggacccgtagggtaaccaggttcgggtaccttcgttccttcgttccgaccggtccccttaccgaacccgaacggggttcccccttacggttcccggtaaccccttcccccgtcggaccctacccccgttcctaacccgaacgtcccg

SEQ ID NO: 347607 - DNA, 590 bp, Homo sapiens
  misc_feature: GZ8MTXP01CLUVH.15.86.H09.1.454.CMB.2.raw
  modified_base (335)..(335): a, c, t, g, unknown or other
  misc_feature (335)..(335): n is a, c, g, or t
  modified_base (420)..(420): a, c, t, g, unknown or other
  misc_feature (420)..(420): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccgagggaacgtcccccagtatataatagaaagttaagagtgatggcagccacgaccgaagggggacggactccccgatcgcttcagtggctccgagttcgngggctgaccgctacctcccaccactcctacccaaccctccagtctgacgatgaggctgagtatcacgtggtggagagacgaccanacaagttgaagtgggaccaagggggtcgggtttggggtgttacggggacggtacggaccgaagccgtacgacccgtcgtaaggccaacggcccgaggtccttcgtccccccgttggcccttcttccgttcccgtccccgtccctccgtcgttacctaacggttcgtaacg

SEQ ID NO: 347608 - DNA, 663 bp, Homo sapiens
  misc_feature: GZ8MTXP01A7UD1.15.86.H09.1.454.CMB.2.raw
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccgagggaacgtcccccagtatataatagaaagttagagtgatggcagccaacgaccggaagggggacgggactccccgatcgcttcgagtcgggctccgagttcgtaggggctgacccgctacctcccacctatcctaccaccctaccacgtcgtcgacgtagtggacggtcgtagaagtactctacgtggtacggaagagacgaccacacgtaattggagtcgggaaccgaagggggtcggggttggggttacggttaccggggacgggaacgggaccgtaaggccgtacggtacccgttacgttaacggccgaacggaccccgttaaggcccttaccggtcccccgttaggttcccttacgttcccttccggttcccccaaccccgttcccgaccggttaccgttaaccggttaacggtaacccgg

SEQ ID NO: 347609 - DNA, 666 bp, Homo sapiens
  misc_feature: GZ8MTXP01CGX01.15.86.H09.1.454.CMB.2.raw
  modified_base (331)..(331): a, c, t, g, unknown or other
  misc_feature (331)..(331): n is a, c, g, or t
  modified_base (599)..(599): a, c, t, g, unknown or other
  misc_feature (599)..(599): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaccgaagggggacggactccccgatcgctcagtggctcagttcgnggggctgaccgctacctccaccatcctccaacctccagtctgacgatgagctgagtatcacgtggtaggagagacgccaaacacgtaaattggaagttacgggaccccgtaaaggggggtaccgggggttttgggggtacggtttcccggggacgggggaacggggaacccgaagggtccgttacggtaaccccgggttccgtaagggttaccgaaccggaccccgaaacggggtcccttaccgggtccccccccgtggggttacccnccgttcccgttcccggttcccccgtccccgttccgtcccggttaccgttaaccggttaacgtccggg

SEQ ID NO: 347610 - DNA, 602 bp, Homo sapiens
  misc_feature: GZ8MTXP01CUSKK.15.86.H09.1.454.CMB.2.raw
  modified_base (328)..(328): a, c, t, g, unknown or other
  misc_feature (328)..(328): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagtaagagtgatggcagccacgaccgaagggggacggatccccgatcgcttcatggctcgagttcgngggggctcgaccgctacctcccaccactctacccaaccctccagtctgacgatgagctgatatcatgngganaganccanacaattgatggaccaaagggggtcgggttggggtacgttcgggacgggaacggggaccaaggccgtacgtacccggtaccgtaggggtccaacgggccccaaaggggtcccttcggtccccccgtgggttcccttaccgttcccttccggttacccccaacctttcccctcggttacctaacggttcgaaccgg

SEQ ID NO: 347611 - DNA, 731 bp, Homo sapiens
  misc_feature: GZ8MTXP01AFEO5.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacacatcgaatggtatcaacagagagcgagggacgtcccccagtatataatagaaagttaagagtgatgcagccacgacggaagggggacggatccccggatcgcttcgagtgggctccgagttcgtgggggactcgaccgctacccctccactactccctacccaaaccctccgaacgtcctaggaccgtaattcgggagggtctagggtaacttaactcccgtaaacgttggggttaggaaggaacgggacgacccgtaaacgaaactaaagtttaggacgttacgggaacccggtaaaggggttaccgggggtttggggttaacggggtttccggggacggggaacggggaacccgttaacggccgttcgggaacccggttacccgttagggggtaacccaccgggacccgaaacgggttccccgtccggtcccccccggttcggttcccgttacccttccggttcccgttaaccccctccccgttcccgttacccggttccgttaaccccggttaacggg

SEQ ID NO: 347612 - DNA, 605 bp, Homo sapiens
  misc_feature: GZ8MTXP01BP4FN.15.86.H09.1.454.CMB.2.raw
  modified_base (250)..(250): a, c, t, g, unknown or other
  misc_feature (250)..(250): n is a, c, g, or t
  modified_base (584)..(584): a, c, t, g, unknown or other
  misc_feature (584)..(584): n is a, c, g, or t
tcagtctacgtagccacgaccggtgctcgatttagtgctatagacttgggtttgggggaagaggaagactgacggtcccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccncaggctccatggaaggggctggagtgggttggacgtttacaaaagtaaaatgatggtagaagaaaatagactacggtgcacccgtagaaaggagattcaccatctacaaagagaataaattacaaaaaacgcggtagtaatttgacaaatgaacaagcctaagaaaaccgaggacacagccgtactattactgtaaccacagattacggaaatgacagtacgaacgtaaaggagcttaagtgtacttttgattagcgtcggggacccagggacaagtcggtcgtcgtctcgttcacgccctacgaacccagggccccagtccggtccttccccncggccacccctcttcccgaag

SEQ ID NO: 347613 - DNA, 647 bp, Homo sapiens
  misc_feature: GZ8MTXP01ANT00.15.86.H09.1.454.CMB.2.raw
  modified_base (288)..(288): a, c, t, g, unknown or other
  misc_feature (288)..(288): n is a, c, g, or t
  modified_base (322)..(322): a, c, t, g, unknown or other
  misc_feature (322)..(322): n is a, c, g, or t
  modified_base (487)..(487): a, c, t, g, unknown or other
  misc_feature (487)..(487): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctcgagggagggctggagtgggtgacgttanaaagtaaatgatggagaagaaatagactacggtnccaccggtagaaaggagattcaccatctacaagagaataatacgaaaaacgtcggttagtatttgacaaatagaacagaacctaagaaaccgagacacgacgccgtactattactgtaaccacagtacgttcggaagtcgactagtacggaaacggttaaagggngacttagtggggttacttttagattacgtcggtcggggcccaaggggactaaggttcgggtacgtcgtctcttccgcgtcccttccgaaccggtaacggccccttacgttcccggttccccttcccccgtggcccctaccccttccctaacgaacgtccg

SEQ ID NO: 347614 - DNA, 622 bp, Homo sapiens
  misc_feature: GZ8MTXP01C8KS6.15.86.H09.1.454.CMB.2.raw
  modified_base (353)..(353): a, c, t, g, unknown or other
  misc_feature (353)..(353): n is a, c, g, or t
  modified_base (436)..(436): a, c, t, g, unknown or other
  misc_feature (436)..(436): n is a, c, g, or t
  modified_base (447)..(447): a, c, t, g, unknown or other
  misc_feature (447)..(447): n is a, c, g, or t
  modified_base (559)..(559): a, c, t, g, unknown or other
  misc_feature (559)..(559): n is a, c, g, or t
  modified_base (578)..(578): a, c, t, g, unknown or other
  misc_feature (578)..(578): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgccaccctaagtagtgagcatccgaacctacaccatcgaatggtatacaacagagaccgacgggaacgtcccccagtataataatagaaagttaagagtgatggacacgaccaacgaaccggaacggggggacggacgtaccccgagtccgcttcagtgggctcgtagttcgnggggctcgaccgtctacctcccaccactcctacccaacctcccagtcgtagacgagtggagcgtagagtctgacgtggagganagacgaccaanaactaagttgagtacgggaccgtaaggggggtcggggttggggtacggttcggggacgggaacggaccgaggccgtcggtaccgtcgtaggccgaacgcccgaagggtcccnccggtcccccgtgttcccncgttccctccgtccccgcctaccgtcgttactaacgcgtaacgg

SEQ ID NO: 347615 - DNA, 641 bp, Homo sapiens
  misc_feature: GZ8MTXP01ESX8F.15.86.H09.1.454.CMB.2.raw
  modified_base (314)..(314): a, c, t, g, unknown or other
  misc_feature (314)..(314): n is a, c, g, or t
  modified_base (350)..(350): a, c, t, g, unknown or other
  misc_feature (350)..(350): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggaaggggctgggagtggggttggacgtttacaaaagtaaaatgatggngaagaaaatagactacggtgacaccgtagaaagganattcaccatactacaagagaataaatacaaaaacgacggtatatttcgacaaatgaacagaacctagaaaccgagacacagtccgtactattactgtaaccacgagattacgggaagtagactagtacggaaacggtaaaggaggtactagtgttcgttttagaagttcgtcgtcgggggacccaggggtaacaaggttggtccgtcgtctcgtcacgtcccttaccgaccgaacgggcccttacgttcccggtcccttccccgtcgccctacccgttcctccgaacgccg

SEQ ID NO: 347616 - DNA, 683 bp, Homo sapiens
  misc_feature: GZ8MTXP01EWFCF.15.86.H09.1.454.CMB.2.raw
  modified_base (402)..(402): a, c, t, g, unknown or other
  misc_feature (402)..(402): n is a, c, g, or t
  modified_base (408)..(408): a, c, t, g, unknown or other
  misc_feature (408)..(408): n is a, c, g, or t
  modified_base (423)..(423): a, c, t, g, unknown or other
  misc_feature (423)..(423): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacacatcgaatggtatcaacagagaccagggaactccccagtatataatagaaagtaagagtgatggcagcacgaccgaagggggacggactccccgatcgctcagtgggctcgagtttcgtgggctgaccgctacctccaccactctacccaacctccagtctagacgatggaggtctaggatatcacgttggngggaanaggacgaccctaaanaaccgtagttcgaagtcgggaaccctaagggggggtacggggtttgggggtacggttacggggacggggaacgggaaccctaaggtcccttcgggtaaccccgttaccggttaaccgggcccaaaccggggtcccccgaaacgggggtcccttccccggcccccccgttacggggttccccttacctttcccggttcccggtttcccccccggcccctttaccgtccggttaccccgttaacgggtttaacccgccgggg

SEQ ID NO: 347617 - DNA, 598 bp, Homo sapiens
  misc_feature: GZ8MTXP01BJP90.15.86.H09.1.454.CMB.2.raw
  modified_base (428)..(428): a, c, t, g, unknown or other
  misc_feature (428)..(428): n is a, c, g, or t
  modified_base (527)..(527): a, c, t, g, unknown or other
  misc_feature (527)..(527): n is a, c, g, or t
  modified_base (546)..(546): a, c, t, g, unknown or other
  misc_feature (546)..(546): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgagtggcagccacgaaccgaagggggacgggactccccgatccgcttcagtgggctccgagttcgtgggctcgaccgctacctccaccatcctaccaaccctaccacgtctgaccgatggaggctgagtatcaacgttggaggagagacgccaanacaaagttgactgggacccaagggggtacggtttggggtcgtccgggaggacggaccaagccgtgaccgtcctaggtccaacggtcccgaaagggtccnccgtcccccgtcggttccnccttcgttaaccgtccccctaacctcccgtcgaccgttaacggttcgaacgg

SEQ ID NO: 347618 - DNA, 575 bp, Homo sapiens
  misc_feature: GZ8MTXP01ESGGN.15.86.H09.1.454.CMB.2.raw
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
  modified_base (413)..(413): a, c, t, g, unknown or other
  misc_feature (413)..(413): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaagggggacggatccccgatcgcttcagtgggctcagttcgtggggctgaccgctacctccaccatctacccaacctccagtctgacgatgagcgtagagtancactgnggagagacgcacaanaattgatagggacctaaggggacgggttggggtcgtcgggcggaagggaccaagcgtgaccgtcgtaggtcaacggcccaaagggcccttcggccccccgttgggccacccttcgttcccgttcccccaaccccgttctccggacttaaccgttaagaaccg

SEQ ID NO: 347619 - DNA, 665 bp, Homo sapiens
  misc_feature: GZ8MTXP01BTU5W.15.86.H09.1.454.CMB.2.raw
  modified_base (431)..(431): a, c, t, g, unknown or other
  misc_feature (431)..(431): n is a, c, g, or t
  modified_base (608)..(608): a, c, t, g, unknown or other
  misc_feature (608)..(608): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgcgtgggagcctcgatcaagctcacctgacacctaagtagtgagcatacgaacctacaccatacgaatgtaatacaacagacgaccgaacgggaaccgtaccccagtaataataagtagaaagtaagagtgagtggacacgaccaacgacggaaggggtacggactacccgagtcgcgtacgacgtcggctcgtaggttcgtcgggctcgaccgctacctacccacctactcctaccacctacagtctagacgtagtacgagtcgtagtacttacnccgtagtgggagggaacgaggtaaccgaccctaaagtaacgtaaagttgaagtacgggtaaccgaaaggggggtcggggtttggggtacgtcgggggacggaaggaaccgaaggtccgtacggacccgttacgacgccgaacgcccgacggtcccgttcccgccccgttggttaccncccgttccgttcccttccccaaccccgttcgtccggttaccgttaacggcggtccgg

SEQ ID NO: 347620 - DNA, 626 bp, Homo sapiens
  misc_feature: GZ8MTXP01BNM04.15.86.H09.1.454.CMB.2.raw
  modified_base (408)..(408): a, c, t, g, unknown or other
  misc_feature (408)..(408): n is a, c, g, or t
  modified_base (421)..(421): a, c, t, g, unknown or other
  misc_feature (421)..(421): n is a, c, g, or t
  modified_base (544)..(544): a, c, t, g, unknown or other
  misc_feature (544)..(544): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccgagggaactccccagtatataatagaaagttaagagtgatggacagaccacgaaccggaagggggacggacgtccccgatcgtctcgagtggctccgtagttcgtggggctcgaccgctacctccaccatcctacccaacctccacgtctgacgagtgagctgatatcatggngagagacgaccanactaagttgaagtgggaacccaagggggtacgggtttggggtacggttccggggacgggaacgggaacccaaggtccgtacggtaacccgtcgtaacgggccgaacggtcccgaacgggtccncccggtccccgtcggttccttaccttcccgtccgttccccccgaaccttccccgtacggttcttaaccggttaacgtaaccg

SEQ ID NO: 347621 - DNA, 623 bp, Homo sapiens
  misc_feature: GZ8MTXP01AO5YU.15.86.H09.1.454.CMB.2.raw
  modified_base (438)..(438): a, c, t, g, unknown or other
  misc_feature (438)..(438): n is a, c, g, or t
  modified_base (618)..(618): a, c, t, g, unknown or other
  misc_feature (618)..(618): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatacaacagagaccagggaacgtcccccagtatataatagaaagttaagagtgatggcagccacgaaccggaagggggacggactccccgatcgcttcagtcggctccgaggtttcgtcggggctcgaccgcgtacctcccaccactcctaccaaccctccgacgtcgcgacgagtgaggctagagttactacacgttggaggagagacgaccaanacgtagttgagtcggaccgaagggggtcggggttgggacgttcggggacgggacgggacccaaggtctacgtacccgttcgtaacggccaaccggtccccaggtcccgttccgtccccgtcgggttaccttccttccgtcccggttaccccccgcccgtcgtaccgttaccgttaacggngtccg

SEQ ID NO: 347622 - DNA, 624 bp, Homo sapiens
  misc_feature: GZ8MTXP01AHVQV.15.86.H09.1.454.CMB.2.raw
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatccgaacctacaccatacgaatggtatacaacagagaccgaacgggaacgtcccccagtatataatagaaagtaagagtgatgcagccacgacgaagggggacggactcccgatcgctcagtcggctcgagttcgtggggctcgaccgctacctcccaccactcctacccacctaccagtcctgaccgtagtggacggtctagacgtatcgtacgtagggtacggagagacgacctaataactaagttgacgtcgggaaccggtaagggggtcggggtttggggtcggttacgggggacggacgggtacaacggtcgtacggtccgtacgagggtccaacggcccgaaggccttcccggcccgttcggaccttccgttccgtcccgtccccgtcctccgtcgacgttaacggttcgtaaccggg

SEQ ID NO: 347623 - DNA, 608 bp, Homo sapiens
  misc_feature: GZ8MTXP01CVNXO.15.86.H09.1.454.CMB.2.raw
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagacgaccgacgggaacgtccccaagtataataagtagaaagttaagagtgatggcacgaccacgaaccggaagggggacggactccccgatccgctcgagtcggtctccgtagtttcggcggggtctcgaccgtctacctcccacctactcctacccaaccctccagtctagacgagtgagctagatactcgagtggaggaacgagacgaccaatactaagtcgagtacggacgagggggtcgggttgggtcgtcggggacggacggacagtccgtcggtacctcgacggtccaacgcccgaggtcccgttccgtcccccggtgttacccttcttccgtcccgtccccgccttcgcgttacgtaacggttcgaaccgg

SEQ ID NO: 347624 - DNA, 645 bp, Homo sapiens
  misc_feature: GZ8MTXP01DTZVZ.15.86.H09.1.454.CMB.2.raw
  modified_base (345)..(345): a, c, t, g, unknown or other
  misc_feature (345)..(345): n is a, c, g, or t
tcagtctacgtagccacgaccggtgctcgatttagtgctatagacttgggtttgggggggacttccctggtctccttctacctactgcccttcatttttctccacaggtctctgtgctctgcctgtgctgactcacgcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcacgaccgaacgaaccggaacgggggacggacaccccgagtcgtcttcagtggctcgagttcgngggctcgaccgctacctccaccactccacccaccctaccagtcgtagaccgatacggacgtctagtagtactcgaacgttggaggagaggacgaccaactaactaagttcgaagtcgggacccggtaaaggggggttacggggtttgggggtacggttacgggggaccgggaaggggacccaggtaccgtcgtacccgtcgtagggtccaacggtccgaacggtccgaccgtccccgtcgggttacccttcgttaccttcccgtcccctaacccgtcctacgccttaacgaacgtaacgg

SEQ ID NO: 347625 - DNA, 550 bp, Homo sapiens
  misc_feature: GZ8MTXP01DMJ9G.15.86.H09.1.454.CMB.2.raw
  modified_base (197)..(197): a, c, t, g, unknown or other
  misc_feature (197)..(197): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
  modified_base (416)..(416): a, c, t, g, unknown or other
  misc_feature (416)..(416): n is a, c, g, or t
tcagtctacgtagccacgaccggtgctcgatttagtgctatagacttgggtttggggggacgttccctggtctccttctacctactgcccttcattttctccacaggtctctgtgctctgcctgtgctgactcagccccgtctgcatctgccttgctgggagcctcgatcaagctcacctgcacctaagtagtgagnatcgaactacacatcgaatggtagtcaacagagaccaggaagtccccagtatataatgaaagttaagagtgatggcagccacaccgaagggggacggactccccgaatcgcttcgagttggggctccgagttcgtgggggcttgaccgctacctccaccatctaccaacctaccatcctgacgatcgaaggctgatatcagtgnganagancctaananatgatagacaagggtggtggtgtcggaggagacagcgtcgtaccgtcgtagcgaacgccgagtccttccgtccccgtcggttccgttccgttccgtccgtcccccgtcctcccgtcgttacctaaccggcgtcg

SEQ ID NO: 347626 - DNA, 646 bp, Homo sapiens
  misc_feature: GZ8MTXP01BJ933.15.86.H09.1.454.CMB.2.raw
  modified_base (587)..(587): a, c, t, g, unknown or other
  misc_feature (587)..(587): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttagagtgatggcagccacgaccgaagggggacggactccccgatcgcttcagtgggctccagttcgtggggctcgaccgctacctccaccatcctacccaaccctccagtctagacgatgaggctgagtactcacgtggtaggaagagacgaccaatacaattgaagtcgggacccgaaagggggtacggggtttgggggtcgttaccgggggacgggtaacgggggaaccctaagggccgttacgggtaccccggttccgtaaggggtcccaaccggccccgaaggggcccttcccgggtccccccccgttgggttcccnccgtttccccgtcccggttcccccgcccttaccccgtcgaccttaaccggttgaaccgg

SEQ ID NO: 347627 - DNA, 679 bp, Homo sapiens
  misc_feature: GZ8MTXP01BXM9I.15.86.H09.1.454.CMB.2.raw
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatgtancaanagagacagggactccccagtatataatagaagtaagagtgatggcacgaccaacgaaccggaaaggggggacggactaccccgagtccgtctcgagtcggctccgtaggttcgtggggctcgaccgctacctacccacctactcctaccctaaccctaccgtacgtcagacgagtcggagtcgtagtacgtatcccgtaagttgggagggaagacggaacgaccccaaataccgtaaagttcggaacgtagggaacccgtaaaggggggtacggggtttcgggggtacggttacggggacgggaaacggggaccctaagggtccttacgggacccgtttccgaaagggtccaacggtcccgaacggtcccttccggccccccgttggaccccttcgttccgtccccttccccggcccttacccggcgttaccttaacggttaacgaacgg

SEQ ID NO: 347628 - DNA, 716 bp, Homo sapiens
  misc_feature: GZ8MTXP01DRXD6.15.86.H09.1.454.CMB.2.raw
  modified_base (291)..(291): a, c, t, g, unknown or other
  misc_feature (291)..(291): n is a, c, g, or t
  modified_base (650)..(650): a, c, t, g, unknown or other
  misc_feature (650)..(650): n is a, c, g, or t
  modified_base (698)..(698): a, c, t, g, unknown or other
  misc_feature (698)..(698): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatggagttgggtccgcaggctcgagggagggctggagtgggtgtacgttanaaaagtaaatgatggagaagaaaatagaacgtacggtgaccgtaaccggtaaggaaaaggaagtacttaccaaccctaattactaacgaaaggaagtaaattaaacttaaacgaaaaaacggtacggttagttaatttacggaactaaaagtagaaacgaacgaaacccgtaaaggaaacccggagaaaccacgacgtaccgttacttaacttactacgtaaaccacgtaagtagtttaacgggaaagtacgacgtaagtaacggaaaacggttaaagggagtacttagttagggtttactttagaattacgtccggtacggggacccaaggggtactacggttcgtcgtctctctacncgtcccaccaccgaacggcccttcgttccggtcccttcccgcgacccncccttctaaccgaagccg

SEQ ID NO: 347629 - DNA, 705 bp, Homo sapiens
  misc_feature: GZ8MTXP01BM24S.15.86.H09.1.454.CMB.2.raw
  modified_base (307)..(307): a, c, t, g, unknown or other
  misc_feature (307)..(307): n is a, c, g, or t
  modified_base (322)..(322): a, c, t, g, unknown or other
  misc_feature (322)..(322): n is a, c, g, or t
  modified_base (656)..(656): a, c, t, g, unknown or other
  misc_feature (656)..(656): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtcagcatctgccttgctgggagcctcgatcaagctcacctgccaccctaagtagtgagcatcgaacctacaccatcgaatggtatcaacagagaccgagggaacgtccccagtatataatagaaagttaagagtgatggcacgccacgacggaagggggacggacnccccgatcgcttcgngtcggctcgagtttcgtcggggctcgaccgctaccgtcccacctactcctacccaaccctccacgtctgaccgagtcgaggtcgtagtacgtactacacgtgggtggagaagacggaccaactaacgtaagttcgaacgtacggggaacccgtaaggggggttacggggttttacgggggttcgggttacgggggacggggaaccgggaccgaacggtccgtacgggtaccccggttacgttaaccgggtccgaaccggtccccgaaacggtcccgttccccggtcccccggtaccggttcccgttacccgtttcccgtcccgggtttcccccnccccggtttcccgtccggttacccgttaacgggttaaccgtaaccgggg

SEQ ID NO: 347630 - DNA, 567 bp, Homo sapiens
  misc_feature: GZ8MTXP01AZPQ5.15.86.H09.1.454.CMB.2.raw
  modified_base (329)..(329): a, c, t, g, unknown or other
  misc_feature (329)..(329): n is a, c, g, or t
  modified_base (412)..(412): a, c, t, g, unknown or other
  misc_feature (412)..(412): n is a, c, g, or t
  modified_base (531)..(531): a, c, t, g, unknown or other
  misc_feature (531)..(531): n is a, c, g, or t
  modified_base (536)..(536): a, c, t, g, unknown or other
  misc_feature (536)..(536): n is a, c, g, or t
  modified_base (544)..(544): a, c, t, g, unknown or other
  misc_feature (544)..(544): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagtaagagtgatggcagccacgaccgaaggggacggatccccgatcgcttcatgggctccagttcgnggggctgccgctacctccaccatcctccaaccctccagtctgacgatgaggctagagattcacgtggtaggagagacgccaanactaattgatggacccaagggggtacggggttggggttcgtcggggacgggacgggaacccaggccgtggacccgtccgtagggcaacggcccaagggccttacgcccccctggttccncttcncgtccccnccctctcggctaacgttcgaacg

SEQ ID NO: 347631 - DNA, 707 bp, Homo sapiens
  misc_feature: GZ8MTXP01A7HZC.15.86.H09.1.454.CMB.2.raw
  modified_base (440)..(440): a, c, t, g, unknown or other
  misc_feature (440)..(440): n is a, c, g, or t
  modified_base (660)..(660): a, c, t, g, unknown or other
  misc_feature (660)..(660): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagaccacgaccgaagggggacggactccccgatcgcttcagtgggctccgagttcgtgggactcgaccgctacctcccacctactcctacccaaccctaccacgtctagaccgtagtggaggcgtagtagtatacgacgtgggtaggagagacgcccaaanacgtaaagttcgaagtacgggacccgaaaggggggttacgggggttttgggggtacggtttaccgggggacggggaaccggggtaaccaaagggtcccgtacgggtaaccccgttacggttaacggggcccaaacggtccccggaaacggggtcccttaccccgggtccccccggttcgggttacccttaccgttcccgttaacccgggtttaccccccnccccgtttccctccggttacccgttaaccgggttaacgtaacccggg

SEQ ID NO: 347632 - DNA, 664 bp, Homo sapiens
  misc_feature: GZ8MTXP01DK2BH.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcacgccccgtctgcatctgccttgctgggagcctcgatcaagctcacctgcaccctagtagtgagcatcgaacctacaccatcgaatggtatcaaacagagaccgagggaacgtcccccagtatataatagaaagttagagtgatggacacgccaacgaccgaaggggggacggactccccgatcgcttcaagtggctccgagtttcgtggggctcgaccgctacctccacctactcctacccaaaccctccaagtctagaccggtaatggtaacggtcgtaggtaagtactcaacgtttggggacgggagaacggaacgtacccctaaacaacgttaagttacggacggttacgggaacccggtaaaggggggttcggggtttagggtcgggtacggggacgggaacggacctagtcgtacggtccgtacgtacggtccaaggtcgttacggtacgttcccgttaccgaccccgttcggttcttacccgttctacccgtccctacccgtcgttccgtaacgttaacgtaacg

SEQ ID NO: 347633 - DNA, 306 bp, Homo sapiens
  misc_feature: GZ8MTXP01E0B8S.15.86.H09.1.454.CMB.2.raw
  modified_base (280)..(280): a, c, t, g, unknown or other
  misc_feature (280)..(280): n is a, c, g, or t
  modified_base (301)..(306): a, c, t, g, unknown or other
  misc_feature (301)..(306): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccaagtatataagtagtaagtaagagtagagngacgacgaccgacgacgaccnnnnnn

SEQ ID NO: 347634 - DNA, 644 bp, Homo sapiens
  misc_feature: GZ8MTXP01ATRF9.15.86.H09.1.454.CMB.2.raw
  modified_base (521)..(521): a, c, t, g, unknown or other
  misc_feature (521)..(521): n is a, c, g, or t
  modified_base (621)..(621): a, c, t, g, unknown or other
  misc_feature (621)..(621): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgccatctgccttgctgggagcctcgatcaagctcacctgcaccctaagtagtgagcatcgaacctacaccatcgaatggtatacaacagagaccagggaacgtcccccagtatataatagaaagttaagagtgatggcacgaccacgaccggaaggggggacgggactccccgatccgtcttcagtgggctccgtagttcgtgggctcgaccgctacctccaccatcctccaaccctccacgtctagaccgtagtgacggctagagttatcaacgtgggtacggaagacgacgtaccaacaacgtaagttcgaaggtcgaccgtaaagggggtcggggtttggggtacgtcgggggacggaaggacccaaggtcccnggtaacccgtcgtaacgggtccaacggaccccgaaagggtcccttccggtaccccccgtggttacccttaccgttcccgtcgttcccccccaaccgttcnccggacttaaccggggcaacggg

SEQ ID NO: 347635 - DNA, 688 bp, Homo sapiens
  misc_feature: GZ8MTXP01COPP6.15.86.H09.1.454.CMB.2.raw
  modified_base (168)..(168): a, c, t, g, unknown or other
  misc_feature (168)..(168): n is a, c, g, or t
  modified_base (324)..(324): a, c, t, g, unknown or other
  misc_feature (324)..(324): n is a, c, g, or t
  modified_base (340)..(340): a, c, t, g, unknown or other
  misc_feature (340)..(340): n is a, c, g, or t
  modified_base (503)..(503): a, c, t, g, unknown or other
  misc_feature (503)..(503): n is a, c, g, or t
  modified_base (657)..(657): a, c, t, g, unknown or other
  misc_feature (657)..(657): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtcgtggggganccttggtaaagccgtggggggtcccttagagtctcctgtgtggcctctggattcactttcagtaatggctggatgagttggtccgcaggctcgagggagggctggagtgggttgacgttacaaagtaaaatgatggagaagaaatagactacggtnacgaccgtagaaaganattcactatctacaagagtaataagttacaaaacggtcggtagtatttacgactaaaatgaaacacgaaccctaagaaaccggaggaacacacgtaccgtacttaattacctagtaacccagtaagtagtacggaagtgaccaagtaccggaaagtaaacggngtacttaagtcggtttacttttaggaacttcgtaccggtgggggacccctaaggggtaacctaaggttcgggttcccgttcgttcctcgttacaacgtccccttaccgaaacccggacgggttccccttacgttccccgggtcctttcccccgnggcccctacccgttcctaaccgaacgtcccg

SEQ ID NO: 347636 - DNA, 622 bp, Homo sapiens
  misc_feature: GZ8MTXP01D95YF.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagaccaacgaccgaagggggacggactccccgatcgcttcagtgggctcgagttcgtgggctcgaccgctacctccaccactcctaccacctccagtctgacatgacggctagagtatcgactggtaggagagaacgaccaacactaagttgagttacgggaccgtaagggggtacggggtttggggttacgggttcggggacgggaacgggaccgaaggtcgtacggtaccgttccgtacggccgaacgcccgaaaggcccgttaccgcccccgttacggttccaccgttccgtcccgttacccctaaccccttccgtccgaccttaacggttcgtaaccgg

SEQ ID NO: 347637 - DNA, 592 bp, Homo sapiens
  misc_feature: GZ8MTXP01BRYCC.15.86.H09.1.454.CMB.2.raw
  modified_base (357)..(357): a, c, t, g, unknown or other
  misc_feature (357)..(357): n is a, c, g, or t
  modified_base (386)..(386): a, c, t, g, unknown or other
  misc_feature (386)..(386): n is a, c, g, or t
  modified_base (399)..(399): a, c, t, g, unknown or other
  misc_feature (399)..(399): n is a, c, g, or t
  modified_base (407)..(407): a, c, t, g, unknown or other
  misc_feature (407)..(407): n is a, c, g, or t
  modified_base (431)..(431): a, c, t, g, unknown or other
  misc_feature (431)..(431): n is a, c, g, or t
tcagtctacgtagccacgaccggtgctcgatttagtgctatagacttgggtttggggggaagaggaagactgacagtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttcggtccgccaggctcgagggaagggctggagtgggttgacgtttacaaaagtaaaatgatggtagaagaaatagactacggtgacaccgtagaaagagattcaccatctanaagagataatacaaaagcgtatacttganaaatgaacagacngaaaacgngacacagcgtatatacagtaccanatagttacggaagtgactagtacgagtaaaggagtctaagtgtctttagactagtcgtggggccaagggactaagtcggtacgtcgtctcttcacgttccacccgacgaccgggccttagtcccgtccctccccgtcgacccttacccgtccttcgaaccg

SEQ ID NO: 347638 - DNA, 768 bp, Homo sapiens
  misc_feature: GZ8MTXP01EMFAG.15.86.H09.1.454.CMB.2.raw
  modified_base (469)..(469): a, c, t, g, unknown or other
  misc_feature (469)..(469): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatgtatacaacagacgaccgagggaacgtacccccagtaatataatagaaagttaagagtagagtggcacgaccaacgaccggaaagggggacggacgtccccgatcgctcagtggactcgtagttcgtgggctcgaccgcctacctaccacctactacctaccctaacctaacccgtacgtcctagaaccgtagtacgacggtacgtagggtatactccgtagttaggggaggaacgaacgggaaaccnccgaaaaccaacgttaaagttacggaacggtacgggtaacccggtaaaggggggggtttcggggggtttcggggttacgggggtttaccggggaacgggggaaaccgggaaaccccgtaagggtcccggtaccggtaacccccggttacgttaaccggggccaaccgggttaccccgaaggggtcccccgttcccggtaccccccggttcgggttaccccgttaccttttccccgtaaccccggttacccccgttcccttccccggtaccgttaccgttaacgggttcgttaacccggg

SEQ ID NO: 347639 - DNA, 715 bp, Homo sapiens
  misc_feature: GZ8MTXP01C9CYV.15.86.H09.1.454.CMB.2.raw
  modified_base (342)..(342): a, c, t, g, unknown or other
  misc_feature (342)..(342): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacacatcgaatggtatcaacagagacgagggaactccccagtataataatagaaagttaagagtgatggacacgaccgaacgaaccggaaagggggacgggacgtaccccgatcgctcagtggctcgtagttcgngggctacgaccgctacctacccaccactcctacccacctacctacgtcgacgacgtaagtggaacgtcgtagattactccgagttggagggaacgaaggaccacctaacaacgttaaagttacgaaggtacgggaacccggtaaagggggttccgggggttttggggtacgggttaccgggggaaaccgggacggggaaacctaggtacccgttacggggtaaccccgttacggttacggccgaaaccggtaccccgaaggggtccccttccccgggtccccccggtagttaaccccttccgttccgtttaaccccggtaccccccttaaccccgttccgtacgttacccgggttaacgaacgggttaaccgg

SEQ ID NO: 347640 - DNA, 696 bp, Homo sapiens
  misc_feature: GZ8MTXP01DLM9I.15.86.H09.1.454.CMB.2.raw
  modified_base (332)..(332): a, c, t, g, unknown or other
  misc_feature (332)..(332): n is a, c, g, or t
tcagtctacgtagccacgaccggtgctcgatttagtgctatagacttgggtttgggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtggggttggacgtttacaaaagtaaaatgatggagaagaaaatagactaggtncaccgtagaaagagatcacatctacaagagaataattacaaaaacgacggtagtatttcgacaaatagaacagacctagaaaccgagacacacgccgtatatactgtaccacagtattacggaagtgacatacggaaacggttaaaggaggtcttaagttgggtctttttaggattacgtcggtacgggggccccaaggggaaacctaagttcggggttccgttcggttccttccgtttcaaccggtccccttacccgaaacccggtaacgggggttcccccttaggttcccccggtttccccgtttcccccccgtcgggtaccccctacccccgttacccttaaccccgaaacggtaaccccg

SEQ ID NO: 347641 - DNA, 830 bp, Homo sapiens
  misc_feature: GZ8MTXP01DCA31.15.86.H09.1.454.CMB.2.raw
  modified_base (755)..(755): a, c, t, g, unknown or other
  misc_feature (755)..(755): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgcgtgggagcctcgatcaagctcacctgcaaccctaagtagtgagcaataccgaacctacacatacgaatggtaatacaacaagaacgaaccgaacgggaaccgtacccccaagtataataaatagaaaagttaagagtagagtgacacgaccgaacgaaccggaacgggggacggaccgtaccccgtagtccgtacgttcgagtcggggtccttaccggtacggtttcggcgggggtctacggtaacccgtacctaccctaccccaaccctacttacccctaaccctaaaccccgttcccgtaacgttccgtacggaaaccgtaaggttcgggaaacggtcgtaagggtaaactttacgtacgtacgttagggacgggaagtacggaacgtacccaagtaaacgtaattacgggaacgtacgggtaacccggtaagggggttacgggggtttcgggggtacggttaaccgggggacggggtaaaccggaacccgttaaaggtccgtaaccggggtaccccgttacggtaaacgggtccgaaacccggtccccggttaaacgggccccttaccccggtacccccgtcgggtttaaccccnccggtttccctttaacccgggtacccccctaacccggttcctccggttaaccgttaacggttaacgtaaccgggg

SEQ ID NO: 347642 - DNA, 678 bp, Homo sapiens
  misc_feature: GZ8MTXP01BJY4Y.15.86.H09.1.454.CMB.2.raw
  modified_base (312)..(312): a, c, t, g, unknown or other
  misc_feature (312)..(312): n is a, c, g, or t
  modified_base (649)..(649): a, c, t, g, unknown or other
  misc_feature (649)..(649): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatacgaacctacaccatcgaatggtatacaacagagaccgagggaacgtaccccagtataataatagaaagttaagagtgagtgcagaccacgaccggaagggggacggacncccgatcgctcgagtcgggctccgtagttcgtgggctcgaccgactacctcccacctactaccctacccaacccctacctacgtcgtacgaacgtagtaggaacggtcgtagaacgttactcgtaactggggtagggaagacgaacgacccaagtaactaagttggaacgtacgggaacccgtaaaggggggttccggggtttgggggtacggttaccggggacgggaacgggtaaccaaggttccgtacggtacccgtcggttacggccaacggcccgaaggtcccttacccggtccccggttcgttaccttccgttcccgttcccggttcccccnccttccgcgttacgtaacggttaacgcgg

SEQ ID NO: 347643 - DNA, 777 bp, Homo sapiens
  misc_feature: GZ8MTXP01CLESN.15.86.H09.1.454.CMB.2.raw
  modified_base (268)..(268): a, c, t, g, unknown or other
  misc_feature (268)..(268): n is a, c, g, or t
  modified_base (299)..(299): a, c, t, g, unknown or other
  misc_feature (299)..(299): n is a, c, g, or t
  modified_base (327)..(327): a, c, t, g, unknown or other
  misc_feature (327)..(327): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacacatcgaatggtatcaacagagaccgagggactccccagtatataatagaaagtaagntgatggcagccacgacgaagggggacggacncccgatcgctcgagtggctcgagttcgnggggctcgaccgtctaccgtaccacctactccctacccaaccctcctacgtctggaaccgagtaggacggtcgtagtaacggttactaccgtaggttacgggtagggaaacgtaaggggaacccgtacccaaaacctaaacggttaaacgttttagggaaacggttacggggtaaaccccggtaaaaggggggtttacggggggtttttacgggggtaccggggtttacccgggggacgggggaaacccgggtaacccgaaagggtcccgtaccgggtaccccggtacgtaacggggtaccccgaacgtaaccccggaaaccgggttcccgttcccgggtacccccccgtttcggggttcccctttaccgggttccctttaaaccccgggggtcccccccgtccctttcccggtcccggttaccgggttaacggttaaaccgcccggggg

SEQ ID NO: 347644 - DNA, 565 bp, Homo sapiens
  misc_feature: GZ8MTXP01DXJL4.15.86.H09.1.454.CMB.2.raw
  modified_base (402)..(402): a, c, t, g, unknown or other
  misc_feature (402)..(402): n is a, c, g, or t
  modified_base (417)..(417): a, c, t, g, unknown or other
  misc_feature (417)..(417): n is a, c, g, or t
  modified_base (527)..(527): a, c, t, g, unknown or other
  misc_feature (527)..(527): n is a, c, g, or t
  modified_base (550)..(550): a, c, t, g, unknown or other
  misc_feature (550)..(550): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatggtatacaacagagacgagggaactcccccagtatataatagaaagttaagagtgatggcacgaccacgacgaagggggacggacgccccgatcgcttcagtggctcgagttcgtggggctcgaccgctacctccaccatcctacccaacctccagtctgacgatgagctgagtatcatggngagagtacgcacganaagttgatagggaccaagggggtacgggttggggtcgtcgggacgggaaggaccaagccgtcggtaacccgtcgtaaggcaacgccccgaaggccttccgcccctggccncttcctaaccgtccccaacctcncgactaacgcgaacg

SEQ ID NO: 347645 - DNA, 765 bp, Homo sapiens
  misc_feature: GZ8MTXP01DULUY.15.86.H09.1.454.CMB.2.raw
  modified_base (229)..(229): a, c, t, g, unknown or other
  misc_feature (229)..(229): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatacgaacctacacatcgaatggtatcaanagagaccgagggaactccccagtataataatagaaagttaagagtgatggacacgaccacgaacggaacgggggacggactaccccgatcgcttcgagtcggcctcgtacggttcgtcggggctcgaccgctaccctacccacctactaccctaccctaaccctacccgtacgtccgtacggaacgtaacgtaggacgggtacgtaggtaacgttactccggtacggttaggggaaggaaacggaagaacccggtacccaaagaaccgttaaagttaggaacggttacgggaaacccggtaaagggggggggttcgggggttttacgggggtacggttaccgggggacggggaaaccgggaaacccgtaagggtacccgtaccggtaacccggttaccggtaacggtcccgaaacgggtaaccccgaagggtccccttacccgggtcccccgttggttaccccttaccgtttcccgttcccgttaccccctaaccccgtttcgacccggttacgttaacgggttaacgtaacccgg

SEQ ID NO: 347646 - DNA, 672 bp, Homo sapiens
  misc_feature: GZ8MTXP01D0A6L.15.86.H09.1.454.CMB.2.raw
  modified_base (406)..(406): a, c, t, g, unknown or other
  misc_feature (406)..(406): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatggagttgggtccgccaggctcgagggagggctggagtgggtgacgttacaaaagtaaaatgatggagaagaaaatagaacgtacggtgacaacccggtagaaaaggaagattacacccatactacaaagagaataaattacaaaaacgtggtagtatttacganaaagtagaacagaaccaagaaccgagaaccacacgaccgtatattactacgtacaacagagttacggaagtagactaatacggaaacggttaaaggagtacttagttggtatttttagaattacgtcgggtaccggggacccgaaggggtaacctaaggttcggtccgttcgtcttaaccttcgaccgtcccttaccgaaccgtaacgggcccttcgttcccgtcccttccccgcgaccctccccgttctaaccgaaggtaacccg

SEQ ID NO: 347647 - DNA, 771 bp, Homo sapiens
  misc_feature: GZ8MTXP01D5B97.15.86.H09.1.454.CMB.2.raw
  modified_base (330)..(330): a, c, t, g, unknown or other
  misc_feature (330)..(330): n is a, c, g, or t
tcagtctacgtagccacgaccggtgctcgatttagtgctatagacttgggttttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatggtatacaacagagaccagggaactcccccaagtataataatagaaagttaagagtgatggacagaccaacgaaccggaagggggacggactccccgagtcgcgttacngtacggctccgtagttcgtgggctcgccgctacctccaccactcctaccctaaccctccgacgtcgtacgacgagtggacggtactgtagttactcgacgttgggacgggagaggacgaccaacgtaacgtaagtttaggaacgtcggggtaaccccgtaaaggggggggttcccgggggttttgggggtttaccggggttaccggggggaaccgggggtaaaccgggggaacccccgtaaagggtcccggttaaccgggtaccccggttacccggttaacgggtccccgaaaccggggttaccccggaaacgggtccccgttccccggtccccccccggttaacgggttcccttaccccgtttccgttaaccccggtttacccccccgtaacccctttcccggtaccggttacccgtttaaccgggttaacggggtcccg

SEQ ID NO: 347648 - DNA, 720 bp, Homo sapiens
  misc_feature: GZ8MTXP01B3V01.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccgagggaactcccccagtaatataatagaaagttaagagtgatggcagaccacgaccgaagggggacggacgtccccgagtcgcttcgagtcgggcctccgaggtttcgtcgggggcttcggaccgcctacctccccaccactcctacccaaccctccagtcagacgatgacgctagatctcagtggaggaagagacgaccctaagactaagttcgagtcgggaccgtaaagggggtcggggtttgggggtaccgttacggggacggggaaacggggacccaagggtacccgttcgggtaaccccgggtttacccgttaacgggggtaacccgaaccccggggtaaccccggaaacggggtcccccgttccccgggtaccccccccggttcgggttaaccccttcccgtttccccggttcccggttacccccccctccccgttaccccgtcggttacccgttaaccgggttaacgtaaccccgggg

SEQ ID NO: 347649 - DNA, 781 bp, Homo sapiens
  misc_feature: GZ8MTXP01CMFVN.15.86.H09.1.454.CMB.2.raw
  modified_base (706)..(706): a, c, t, g, unknown or other
  misc_feature (706)..(706): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgccacctaagtagtgagcatcgaacctacaccatcgaatggtatacaacagacgaccgacgggaacgtccccagtatataatagaaagttagagtgatggacagaccacgaaccggaagggggacggacctaccccgagtccgtacttcgacgtcgggtcctaccgtaggtttcggtcgggggcctcggacccgcctaccctaccccaccctacttaccctaccctaaaccctcccgtacgttcctacggaaccgagttagggacggtcgtaggacgttaactcgtaacggtgggtacgggaacgaacggaacgaccccaaagaaccgttaagttacgaacggtacgggtaacccggtaaaggggggttaccgggggttttagggggtccgggttaccgggggacgggaaacggggaacccgtaacggtaccggtaccggtaccccgggtccggttaacgggtcccgaaccgggacccgttaacgggtccccgttaccccggtcccccggttcgggtttaccccnccgtttccccggttccccggtttccccccgtccccgttcccgtccggttacccggttaacggttaacgggtccgg

SEQ ID NO: 347650 - DNA, 595 bp, Homo sapiens
  misc_feature: GZ8MTXP01AU42Q.15.86.H09.1.454.CMB.2.raw
  modified_base (394)..(394): a, c, t, g, unknown or other
  misc_feature (394)..(394): n is a, c, g, or t
  modified_base (407)..(407): a, c, t, g, unknown or other
  misc_feature (407)..(407): n is a, c, g, or t
  modified_base (416)..(416): a, c, t, g, unknown or other
  misc_feature (416)..(416): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccgagggaacgtccccccagtatataatgaaagttaagagtgatggcagccacgacgaaggggacggactcccgatcgcttcatggctcagttcgtgggctgccgtctacctccaccatcctaccaacctccaagtctgacgatggagctaggatttaacncgagtggagaganacgacctanaagtagttgactacgggacgtaaggggggttcggggtttggggtacgtacggggacggacggacctagtccgtacgtaacccgtgacggtccaacgcccgaggtcccttcccgccccgtcgttacccttccgttccgttccccgtccccgtcccttccgtacgttaccgtaacgcgaag

SEQ ID NO: 347651 - DNA, 724 bp, Homo sapiens
  misc_feature: GZ8MTXP01DTNP5.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgccaccctaagtagtgagcatcgaacctacaccatcgaatggtatcaacagagaccgagggaactccccaagtataataatagaaagttaagagtgatggcacgaccaacgaaccggaagggggacggactccccgatcgcttcgagtcggctcgtagttcgtggggctcgaccgctacctccacctactcctacccaacctccagtcgacgacgagtaggagtctagagttactcgtaacgttggaggaagaacgaacgacccaaatacgaaagttcgagttacgggacccgtaaaggggggttccggggtttgggggttcgggttacggggacggggaacgggaacccgtaaagggtccgtcggtaacccggttaccggttacgggtaccgaaccggaaccccggaaacggggtccccttacccgggtcccccccgttcggggttacccctttcccgttccccggtttccccgggtttaaccccccctccccgtttcccggtcccggttaaccggtttaaccggttaacggtaacccgggg

SEQ ID NO: 347652 - DNA, 712 bp, Homo sapiens
  misc_feature: GZ8MTXP01B6UGH.15.86.H09.1.454.CMB.2.raw
  modified_base (430)..(430): a, c, t, g, unknown or other
  misc_feature (430)..(430): n is a, c, g, or t
  modified_base (441)..(441): a, c, t, g, unknown or other
  misc_feature (441)..(441): n is a, c, g, or t
  modified_base (670)..(670): a, c, t, g, unknown or other
  misc_feature (670)..(670): n is a, c, g, or t
tcagtctacgtagccacgaccggtgctcgatttagtgctatagacttgggtttgggggggaagaggaagactgacggtccccccaggagttcgggctgagctgggttttccttgctgctatcttaaaaggtgtccagtgtgaagtgcaggtggtggagtctgggggagccttgggtaaagcctggggggtcccttagagtctcctgtgtggcctctggattcacttttagtaatggctggatggagttgggtccgccaggctccgaggggaggggctgggaggtgggttggacgtttacaaaagtaaaatgatggtagaagaaaatagactacggtgacacccgtagaaaggaagattcaccatctacaagagataattacaaaacgtacggtagtattagacaaatagaacacgacctaaagaaaccgngacacagcctntattactagtaccacagtagtcggaagtgacaagtacgaacggttaaagggacgtacttaattggttacgtttttagaactttacgttccgggtacgggggaccccgaagggggaacctaaagggttccggggtaccttccggttccttccgttaaccgaccgttcccccgtacccacccggaaaccgggggtccccttacggtttccccggttcccctttccccccgnggcccctacccccgttccccgttacgaaccggaacgtccccg

SEQ ID NO: 347653 - DNA, 721 bp, Homo sapiens
  misc_feature: GZ8MTXP01AYDPE.15.86.H09.1.454.CMB.2.raw
  modified_base (295)..(295): a, c, t, g, unknown or other
  misc_feature (295)..(295): n is a, c, g, or t
tcagtctacgtagccacgaccggtgctcgatttagtgctatagacttgggtttgggggagctctgggagaggagccccagccttgggatccccaagtgttttcattcagtgatcaggactgaacacagaggactcaccatggagttcgggctgagcttgggttttccttgctgctatcttaaaaggtgtccagtgtgaagtgcgaggtggtggagtcgtgggggagccgttagggtaacgccgtgggggtcccttagagtctccgtgtgtcggcctctggattcactttcagtanggctggatggaggttcgggcccgtccgaggccgtaccggaggggacggggcgtgggaggtggggttaggaacgtttaagaaaagtaaatgagtggtagaaagaaatagaacgtacggtacgaaccgaacccggtaaggaaaaggtaaagacttaccgaacctactactacgaaagagtaattaaaacttacgaaaaacggtgggttaattagtttacgaactaaagacgaaacacgtaacccgtaaaggggaaaaccggaggaacctaccgaacggtcccttactaagtttacctcgtaaacccgagtaaaggtacgttaacgggaaagttcgaaccgaaggttaacccgaaagggttaaaacgggcgttacgttaagttcgtttaacgtttagacgttacggtccggggttaaccgggtaaccgg

SEQ ID NO: 347654 - DNA, 842 bp, Homo sapiens
  misc_feature: GZ8MTXP01AECD5.15.86.H09.1.454.CMB.2.raw
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatccgaacctacaccatcgaatggtatacaacagacgacgagggaaccgtccccagtatataatagaaagttaagagtgatgcacgaccacgaaccggaagggggacggaccgtaccccgagtcgtcttcgagtcgggtcctcgaggttcggtcggggtctcgaccgctacctacccacctactcctacccaccctccacgtcgtagacgtagtcggacggtcgtacgtaacgttactaccgtaaggtgggtaagggaacgaaacggaacccggtacccaaacccgtaaaacgttaaaggtttaccgggaacgggttaccggggtaaacccgtaaagggggggggggtttcccgggggtttagggggttccgggttaacccggggggaacgggggaaccggggtaaaccaaacggggtcccgttaaccggggtaccccgggtttaaccggttaacgggggcccgaaaccccggggaacccggaaacgggggtttccccccccgttacccccgggggttacccccggttacccgggttaccccgttccccggttttccccgggttccccccggttccccccggttccccggttacccgggtaccccgggttaaccggttaaccggggttaaccggtaaccgggg

SEQ ID NO: 347655 - DNA, 666 bp, Homo sapiens
  misc_feature: GZ8MTXP01CP0TV.15.86.H09.1.454.CMB.2.raw
  modified_base (227)..(227): a, c, t, g, unknown or other
  misc_feature (227)..(227): n is a, c, g, or t
  modified_base (231)..(231): a, c, t, g, unknown or other
  misc_feature (231)..(231): n is a, c, g, or t
  modified_base (273)..(273): a, c, t, g, unknown or other
  misc_feature (273)..(273): n is a, c, g, or t
  modified_base (332)..(332): a, c, t, g, unknown or other
  misc_feature (332)..(332): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatacgaacctacaccatcgaatggtancaanagagacgaggactccccagtatataatagaaagtagagtgangcagccaacgaaccggaaggggacggactcccgatcgtctcgagtggctcgtagttcgngggctcgaccgctacctacccacctactcctacccaacctccagtctagacgagtcggagactagatcacgaggttggaggagaacggacaccaactaagtaagttcggaacgtcgggtaaacccgtaaaggggggttccgggggttttggggtacggtaccgggggacgggacggaacccgtaaggtcccgtacggtaccccgtcggttaacggcccaacggtaccccggttagggtcccttcccgggacccccgttgggttacccttccggtttcccttcccgtaaccccctccgtttcccgacggttaccgttaaccgttaaggtcccggg

SEQ ID NO: 347656 - DNA, 723 bp, Homo sapiens
  misc_feature: GZ8MTXP01BTTIH.15.86.H09.1.454.CMB.2.raw
  modified_base (292)..(292): a, c, t, g, unknown or other
  misc_feature (292)..(292): n is a, c, g, or t
  modified_base (355)..(355): a, c, t, g, unknown or other
  misc_feature (355)..(355): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctccgagggaaggggctggagtgggtggacgtttanaaaagtaaaatgatggtagaagaaaatgaacgttacgggtgaccgacccggtagaaagggaanattacaccatctacaagagaataaattacaaaaaacgtcggtagttatttagactaaatgaaacagaaccctaagaaacccggagggaaccaacgacgaccgttactaaactttactcgtaaccaactaggaactttacgggaaggttacggaccaagttacggaacggttaaaaaggggacgtacgtttagtcggtttacgttttagaacttacgttcgggtaccggggaccggtaaggtacctaggttcggttacgttccgtcttaacgttccgacgtccccgttaccgaaccggtacggttccccttacggtttcccggtccccttcccccgtcgcccctaccccgttccctaaccgaacggccg

SEQ ID NO: 347657 - DNA, 693 bp, Homo sapiens
  misc_feature: GZ8MTXP01CY4K0.15.86.H09.1.454.CMB.2.raw
  modified_base (344)..(344): a, c, t, g, unknown or other
  misc_feature (344)..(344): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatacaacagagaccgagggaacgtcccccaagtatataatagaaagttaagagtgatggcagaccacgaaccgaaggggggacggactccccgagtcgtcttcagtgggctcgtagttcggnggggctgaccgtctacctcccaccatcctaccctaacctcccaagtctacgacgagtgagcgtagagtactccgaagtggaggaagacggacaccaacaataattagagtagggaaccctaaagggggtccggggtttggggtcgttacgggggacgggtacgggaaccacggtaccgtacgggtaaccccgtccggtaacgggtcccgaacggtcccccgaaagggggtccccttcccggtcccccccgttggggttccccgttaccctttcccggttccccggtttaccccccgtaaccccctttcccgacccggttaccgttaacccgggttaaccgtaacccggg

SEQ ID NO: 347658 - DNA, 760 bp, Homo sapiens
  misc_feature: GZ8MTXP01ARLC5.15.86.H09.1.454.CMB.2.raw
  modified_base (293)..(293): a, c, t, g, unknown or other
  misc_feature (293)..(293): n is a, c, g, or t
  modified_base (738)..(738): a, c, t, g, unknown or other
  misc_feature (738)..(738): n is a, c, g, or t
  modified_base (751)..(751): a, c, t, g, unknown or other
  misc_feature (751)..(751): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgccaggctccgagggagggctggagtgggttggacgttanaaaagtaaaatgatggagaagaaatagactacgggtcgaccaaccggtagaaaacggaagtaacttaccaacctatactacgaaagaagaaattaaacttaacgaaaaaacggtacggttagttaatttacggaacctaaaagtcgaaaaccgaacgtaaacccgtaaacgggaaaaccccggagggaaacccaaaccgaacggtaccccgttacttaaactttaacccgtacggtaaacccaacgaaggtacgtttaacgggaaagttacgactaacgttacgggaaacggttaaaacgggaggtaccttaagttcggggttactttttaaggattaacgtccggtacgggggccccaaggggtaacctaagttcggggtacctcgttcctaactcacggtcccttaccgaacgaacgggcccagttcccggtcccttccccgngccccaccttccncgaagcccg

SEQ ID NO: 347659 - DNA, 688 bp, Homo sapiens
  misc_feature: GZ8MTXP01EIP4M.15.86.H09.1.454.CMB.2.raw
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
  modified_base (462)..(462): a, c, t, g, unknown or other
  misc_feature (462)..(462): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggaaggggctggagtgggttggacgtttacaaaagtaaaatgatggtagaagaaaatagaactaggtgacaaccgtagaaaaggagtattcaaccatctanaaaganaataattacaaaaagtcggtataatttacgactaaatagaacagaacctaacgaaaccgaggaacacgagccctatattacagtaccaanagattacgggaagttacgacgaaagttccggaaagttaaacggaggtacttagttacggttcgtttttagaactttacgtccggtcgggggacccgaaggggaacctaggtgggtccgttcgtcttctttcgacggtacccttacccgacgtaaccgggcccttacggttccccgttcccgtcccccgttcggaaccctcccccttactaacccgaacgtcccggg

SEQ ID NO: 347660 - DNA, 679 bp, Homo sapiens
  misc_feature: GZ8MTXP01AY9Q8.15.86.H09.1.454.CMB.2.raw
  modified_base (254)..(254): a, c, t, g, unknown or other
  misc_feature (254)..(254): n is a, c, g, or t
  modified_base (344)..(344): a, c, t, g, unknown or other
  misc_feature (344)..(344): n is a, c, g, or t
  modified_base (533)..(533): a, c, t, g, unknown or other
  misc_feature (533)..(533): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctggggggagccttggtaaagccgtggggggtcccttagagtctcctgtgtggcctctggattcactttcagtaatggctggatgagttgggtccncaggctcgagggagggctggagtgggttggacgttacaaaagtaaatgatggtagaagaaatagactacggtgaccaccgtagaaagganatcaaccatctacaaagagtaataaattacaaaaacgtacggtattatttacgactaaaatgaaacacgaacctaaggaaacccgaggaaccaacgaacgtacccgttacttaaactttaacctacgttaacccaacgtaacgtaagttaccgggaagtcgacctaagtaccgggaaacggttaaaggnggtacttaagttggttctttttagacgttacgtcggtacggggccgagggtactagtcggtccgtcgtctcttcacgtcccttacgaccgacgggccccttgttcccggtccctccccgtgcccctacccttcctaaccgaacgcc

SEQ ID NO: 347661 - DNA, 686 bp, Homo sapiens
  misc_feature: GZ8MTXP01EDZS3.15.86.H09.1.454.CMB.2.raw
  modified_base (232)..(232): a, c, t, g, unknown or other
  misc_feature (232)..(232): n is a, c, g, or t
  modified_base (654)..(654): a, c, t, g, unknown or other
  misc_feature (654)..(654): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgccaccctaagtagtgagcataccgaacctacaccatcgaatggtatcaanagagacgaggaacgtccccagtataataatagaaagttaagagtgatggcagaccacgaaccggaagggggacggactccccgatcgtctcgagtcgggtcctccgtagtttcggtggggtcgtcgaccgcctacctcccacctactcctaccctaacctaccagtcagacgagtcggaggtcgtagtagtactcgtacgtggggtacggaaagacggaaccgaaccaacgtaacgtaaagtacgtacgttacgggaacccgtaaggggggttacggggtttgggggtaccggttcggggacggggaaggtaacccgaagggtccgttacggtaacccggttacggtacgggtccgaaaccggcccgaagggtcccttcccggacccccgtttgacccttccgttccttccccgttaccccnccccttccgtacgttaccgttcgaacgtcggg

SEQ ID NO: 347662 - DNA, 695 bp, Homo sapiens
  misc_feature: GZ8MTXP01CG923.15.86.H09.1.454.CMB.2.raw
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatacgaacctacacatcgaatggtatacaacagacgaccgagggaaccgtccccagtataataatagaaagtaagagtgatggacagaccaacgaaccggaagggggacggactcccgatccgcttcgagtggtctccgtaggttcgtggggctacgaccgctacctcccaccactcctacccaaccctaccacgtcgtagaacgagtcggaggtcgtagaagttactcgtaacgtgggtaggaacgacggacacccgaataacgtaagttggaacgtacggggtaacccgtaaagggggggggttcgggggtttcgggggttcgggttaccgggggaacggaacggggacccgtaaggtccgtaacggtaaccccgtcgtaaacgggccggaaccgtacccggaggtcccttccgggtaccccccgtggttaccttcccgttccgttcccgtccccgaaccccgttcgtcggttaccgttaacgggcgtaacggg

SEQ ID NO: 347663 - DNA, 786 bp, Homo sapiens
  misc_feature: GZ8MTXP01APRZR.15.86.H09.1.454.CMB.2.raw
tcagtctacgtagccacgaccggtgctcgatttagtgctatagacttgggtttggggagctctgggagaggagccccagccttgggatccccaagtgttttcattcagtgatcaggactgaacacagaggactcaccatggagttcggctgagcttgggtttccttgctgctatacttaaaggtgtccagtgtgaagtgcgaggtggtggagtcgtgggggagtccgttaggtaacgccggtgggggtcccttaggacgtctccgtgtgtggtccgtcgtggtattcgtactttcgaagtaagtggcgtaggtagtggtagggttcgggtcccgccgacggtccgtaccggaaggggacgggggcgtgggtagggttgggttacggtaacgtttaacgaaaaagtaaagtgtaagtagggtagaaagtaaaagtagaacgtacgggtacgaaacccgtaacccggtaagaaacggtaaacgtacttaccgaactactactaacgaaagtaagtaaacttaaacgtaaacgtaaaaaccggtggttaagttaagtttacgaaactaaaagacggaaactaccgggaacccgtaaacgggggaaaaccgaacggaacccgaccgtaaccggtacccgttacttaacgtttaaccgtacgtaaaccctaaccgaaggttaaacggttcgaaaggttccgacttaaacggacgggtaaaccgggttaaaggcggttaccttaaggtgtttaagtttaaggacgttacggttccggaaccggggtaaccgg

SEQ ID NO: 347664 - DNA, 762 bp, Homo sapiens
  misc_feature: GZ8MTXP01BENM3.15.86.H09.1.454.CMB.2.raw
  modified_base (252)..(252): a, c, t, g, unknown or other
  misc_feature (252)..(252): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgccccgtctgcatctgccttgctgggagcctcgatcaagctcacctgcaccctaagtagtgagcatcgaacctacaccatcgaatggtatcaacagacgacaggactccccagtatanatagaagtaagagtgatggcacgccacgaacggaacgggggacggactccccgagtcgcttcgagtcgggctcgtagttcgtgggggctcgaccgctacctccacctatccacccacccgtaccacgtctacgacgtagtggtacggctagggtaaactcgttaccgaggtttaggggaccgggaaagagggaaacccgcccctttaaaacgtaacgttaaggttacgaacggttaacggggaaacccggttaaggggggggtttacgggggtttcgggggttacgggtaccgggggaacgggtaaccgggtaacctaagggtcccgttaaccgggtaccccgttaccggtaacgggacccgtaaccggaaccccgggttacggtccccgttccccgggttacccccggttcggttaccccgttaccctttccccggttaacccccgttaccccccgtaacccgttcccggttacccggttacccggttaacgggttaaccggtcccggg

SEQ ID NO: 347665 - DNA, 622 bp, Homo sapiens
  misc_feature: GZ8MTXP01DHPWI.15.86.H09.1.454.CMB.2.raw
  modified_base (358)..(358): a, c, t, g, unknown or other
  misc_feature (358)..(358): n is a, c, g, or t
  modified_base (379)..(379): a, c, t, g, unknown or other
  misc_feature (379)..(379): n is a, c, g, or t
  modified_base (467)..(467): a, c, t, g, unknown or other
  misc_feature (467)..(467): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctcgagggagggctggagtgggttgacgtttacaaaagtaaaatgatggagaagaaatagactacggtgcaccgtagaaaggagattcacatctacaaganaataatacaaaacgtacggtntattcgacaaatgaacagaacctagaaccgagacacagccgtactattactagtacacagattcggaagtgcagtacgacgtaaaggngtacttagtgttctttgatcgtcggtcgggaccgaaggtactaggtcggtcgtcgttcttctccgacgtccccgttaccgaaccggaccgggttacccttcggttccccgttcccttccccgcggcccctaccccgttaccctaacgaacgtccg

SEQ ID NO: 347666 - DNA, 640 bp, Homo sapiens
  misc_feature: GZ8MTXP01EH0JF.15.86.H09.1.454.CMB.2.raw
  modified_base (434)..(434): a, c, t, g, unknown or other
  misc_feature (434)..(434): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagaccacaaccggaagggggacggactccccgatcgcttcagtcgggctcgagttcgtgggctcgaccgcctacctcccaccactcctacccaaccctacccaagtcgtagaaccgagttcgaacgggtctaggagttactccgagttagggnggaacgagtaacgaccaacacgtaaattgaattacggacccgtaagggtacggggttggggtcgtacggggcggaaggaccagttcgacgacccgttcgtaaggccgaacgtcccgaaggtccttacccggcccccttgggcccttaccgttttcccggtcccccaccccggtttcacccgtacggttaccggtgaacccgtgggg

SEQ ID NO: 347667 - DNA, 659 bp, Homo sapiens
  misc_feature: GZ8MTXP01BDOLJ.15.86.H09.1.454.CMB.2.raw
  modified_base (301)..(301): a, c, t, g, unknown or other
  misc_feature (301)..(301): n is a, c, g, or t
  modified_base (499)..(499): a, c, t, g, unknown or other
  misc_feature (499)..(499): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctccgagggagggctgggagtgggttgacgttacaaaagtaaaangatggagaagaaaatagactacggtgaccaccgtagaaaggagattcaccatctacaagagaataaattacaaaaacgtcggtatatttcgacaaatgaaacagaaccctaagaaacccgaggaaacacgacgccgttactaattactgtaaccaacgagtacttacgggaaagttgactagtacggaacgtaaaggnggtactagttggtacttttagaacttagtacggtcgggggacccaaggggaacctaaggttcggtacgtccgtctcttcacgtcccttaccgaccgaacgggccccttagttcccggttaacctcccccgtgcccctacccttccctaaccgaacgcccg

SEQ ID NO: 347668 - DNA, 693 bp, Homo sapiens
  misc_feature: GZ8MTXP01DTZGH.15.86.H09.1.454.CMB.2.raw
  modified_base (254)..(254): a, c, t, g, unknown or other
  misc_feature (254)..(254): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacagggaacgtccccagtatanaatagaaagttaagagtgatggcagaccaacgaccgaaagggggacggactccccgatcgcttcagtggctcagttcgtggggctgaccgctacctccaccactcctccaacctccaagtctagacgaagtgaggctagtagtatcaagtggaggaagagaacgccaaacaacaaagttagatacgggaacccgaaaggggggtcggggtttgggggttacgggttaccgggggacggggaacggggaaacccgaaggtaccggtacgggtaaacccggttccgttaaacgggtcccgaaacgggtcccccgaaaggggtccccttacccggtcccccccggttaacgggttccccttaacccggtttcccttccccgggttacccccctaaccccgtttccgtacccggttaccttaaccgggttaagtaaccccggg

SEQ ID NO: 347669 - DNA, 628 bp, Homo sapiens
  misc_feature: GZ8MTXP01CVRU0.15.86.H09.1.454.CMB.2.raw
  modified_base (296)..(296): a, c, t, g, unknown or other
  misc_feature (296)..(296): n is a, c, g, or t
  modified_base (324)..(324): a, c, t, g, unknown or other
  misc_feature (324)..(324): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacacatcgaatggtatacaacagagaccgagggactccccagtatataatagaaagtagagtgatgcagccacgacgaaggggacgacncccgatcgctcagtggctcgagtttcgngggctcgaccgctacctcccaccactcctacccaaccctacccagtctagaccgagtggacgctgagtatcgacgtggtaggagagacacgaacaacgtaagttgacgtcgggaaccgtaagggggttaacggggtttggggttacggttacggggacggggtaaccgggaacgacggtcgtaccggtaccgtaccggttacggccgaacgtcccggaacggcccgttaccgtcccccgtgttacccgccttcccggtccgttccccgcccttccgtacgttacccttaacggaacgtaacggg

SEQ ID NO: 347670 - DNA, 675 bp, Homo sapiens
  misc_feature: GZ8MTXP01APRE5.15.86.H09.1.454.CMB.2.raw
  modified_base (292)..(292): a, c, t, g, unknown or other
  misc_feature (292)..(292): n is a, c, g, or t
  modified_base (608)..(608): a, c, t, g, unknown or other
  misc_feature (608)..(608): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttgggtaaagccgtggggggtcccttagagtctcctgtgtggcctctggattcactttcagtaatggctggatgagttgggtccgccaggctcgagggagggctggagtgggttggacgttanaaaagtaaatgatggagaagaaatagactacggtgacgaacccgtagaaaggagacttcaccatactacaaagagaataaagttacaaaaacggtcggttagtaatttagactaaatagaaacagaaccgtaagaaaccgaggaaccaacgacgtaccgttactacgtttaactacgtaacccaacgagtagttacgggaagtacggactagtacggaacggttaaaagggcggtacttagtggggttacttttaggattacgtcggtacgggggacccaggggtactaagttgggtctcgtctctcgacgtcccnccgaaccgacgggcccttagttcccggtcccttccccgtggccccacccgttccgtccgaaacgccg

SEQ ID NO: 347671 - DNA, 633 bp, Homo sapiens
  misc_feature: GZ8MTXP01CGSE1.15.86.H09.1.454.CMB.2.raw
  modified_base (333)..(333): a, c, t, g, unknown or other
  misc_feature (333)..(333): n is a, c, g, or t
  modified_base (380)..(380): a, c, t, g, unknown or other
  misc_feature (380)..(380): n is a, c, g, or t
  modified_base (411)..(411): a, c, t, g, unknown or other
  misc_feature (411)..(411): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcacctaagtagtgagcatcgaacctacacatcgaatggtatcaacagagacgagggaactccccagtataataatagaaagtaagagtgagtgacagaccgaacgacggaaggggacggactccccgatcgctcgagtggctcgtagttcgngggctcgaccgctacctcccacctactcctacccaacctccgaatcngaacgagtggagtctagagtaatcacgtggngagacgacaccaagacaagttcgagtcggaaccgaagggggtcgggtttaggggtacggttacggggacgggtaacggaccgaaaggtcccgtacggtaacccgttcgacggtaccgaacggacccgttaaggcccttccggaccccccgttgggttaccccttacgttcccgtcccgttccccgccccgttcgccgttaccgtaacggttaacgtaacggg

SEQ ID NO: 347672 - DNA, 737 bp, Homo sapiens
  misc_feature: GZ8MTXP01AWF47.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatggtatacaacagagaccgagggaacgtccccagtatataatagaaagtagagtgatggcagccacgaccggaagggggacggactccccgatcgcttcagtgggcctccgtagttcggtcgggggctcggaccgtcctacctaccccacctactccctacccctaaccctacccgacgttcgtacggaaccgtagttacggacgggtctaggtaacgttactacgtacggttggggtagggaaggaacgtaccggacccaacgtaaacgtaagttggaacggtacgggaaccggtaaagggggggttacgggggtttgggggtacggttaccggggacggggaacggggaccaagggtccgtacgggtaaccccggttcgtacgggcccaacggtaccccgagggtccccttccgggtacccccccgttggggttaccccttaccgtttccccgttaaccccgttccccccgtaaccccttcccggtaccgttaccgttaacgggttcgtaaccggg

SEQ ID NO: 347673 - DNA, 666 bp, Homo sapiens
  misc_feature: GZ8MTXP01A3T14.15.86.H09.1.454.CMB.2.raw
  modified_base (439)..(439): a, c, t, g, unknown or other
  misc_feature (439)..(439): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccgagggaacgtcccccagtatataatagaaagttaagagtgagtggcagaccacgaccgaagggggacgggactccccgatcgcttcgagtgggcctccgtagttcgtcggggctcgacccgctacctcccaccactccctacccaaccctccacgtctcgacgagtgagctgagtatcgaacgtgggtaggagagacgcccaanactaagttgagtcgggaccgaagggggtacggggtttggggtacggttcggggacgggaacggaacccaaggccgttcggtaaccccgttccgttaaacggggccaacgggtcccccgaaaggggtcccttacccgggccccccgttcggggttacccttcctttcccggttccgttccccccggtcccttcccgtccggttacttaacccggttaagtaacccggg

SEQ ID NO: 347674 - DNA, 673 bp, Homo sapiens
  misc_feature: GZ8MTXP01BGN8V.15.86.H09.1.454.CMB.2.raw
  modified_base (628)..(628): a, c, t, g, unknown or other
  misc_feature (628)..(628): n is a, c, g, or t
  modified_base (637)..(637): a, c, t, g, unknown or other
  misc_feature (637)..(637): n is a, c, g, or t
  modified_base (667)..(667): a, c, t, g, unknown or other
  misc_feature (667)..(667): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctgatcaagctcacctgcaccctaagtagtgagcatcgaacctacaccatcgaatggtatcaacagagaccgagggactccccagtatataatagaaagttaagagtgagtggacagaccaacgaccggaacggggggacggactccccgatcgctcagtcggctccgtgttcggtgggtctcgaccgtcctacctccccaccacttccctaccctaccctaccgtaacgtctacggacgtagtaggacggtcgacgtagtactacgacggttagggtagggaagagaaccgaccctaaacgaacgtaaagttgaacgtcgggaaccccggaaagggggggttcggggtttaacgggggtgggttaccgggggacgggaacggggtaacccaaggtccgtcggtaccccggttacgtacggaccgtaacggaccttaggggcccttccggcccccgtacgttcnccgtttccncgtcccccgtcctcgtccgacttaaccggnggtccg

SEQ ID NO: 347675 - DNA, 628 bp, Homo sapiens
  misc_feature: GZ8MTXP01DECJQ.15.86.H09.1.454.CMB.2.raw
  modified_base (459)..(459): a, c, t, g, unknown or other
  misc_feature (459)..(459): n is a, c, g, or t
  modified_base (496)..(496): a, c, t, g, unknown or other
  misc_feature (496)..(496): n is a, c, g, or t
  modified_base (587)..(587): a, c, t, g, unknown or other
  misc_feature (587)..(587): n is a, c, g, or t
  modified_base (610)..(610): a, c, t, g, unknown or other
  misc_feature (610)..(610): n is a, c, g, or t
tcagtctacgtagccacgaccggtgctcgatttagtgctatagacttgggtttgggggggaagaggaagactgacggtccccccaggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatggagttgggtccgccaggctccgaggggaaggggctggaggtgggttggacgttacaaaagtaaaatgatggagaagaaatagactacggtgacaccgtagaaagagatcacatctacaagagtaataattacaaaaacgtacggtagtactttagacaaatagaaacacgaacctaagaaaccgaggaacacacgccgtactatactatacccanagagttacggaagtcgactatacggaaacgtaaaggngtactagtggttcttttagattacgtcggtacgggcccaaggggtaaccagttcggtcgtcgtctctcacgcccttacgaccgacggcccngttcccgtccctccccgtgcccncccttcctccaagtcccg

SEQ ID NO: 347676 - DNA, 691 bp, Homo sapiens
  misc_feature: GZ8MTXP01D642I.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatgtatacaacagacgacgaggaacgtccccagtaatataatagaaagttaagagtgatggcacgaccacgaccggaaggggacggactccccgagtcgtactcagtggtcctcgtacggttcgtgggcttcgaccgtcctacctaccaccactcctacccaaccctacctacgtcgtagacgtacgtaggacgggtctaggtaacttacgtccaggttaggaggaagaacgaacggacctaaacaataacgttagagtacgggacccgtaaagggggttaccgggggtttggggttacgggttacggggacgggtaaaccgggactaaaggtccctagggtacccgttacgttacgggccgaaacggccccgaaaggggtccccttccgggcccccgtttaggttaccttcccgtttccggtcccgtttccccgcccgttcccgtacggttactaaccgggttaacgtccggg

SEQ ID NO: 347677 - DNA, 678 bp, Homo sapiens
  misc_feature: GZ8MTXP01D9V2K.15.86.H09.1.454.CMB.2.raw
  modified_base (340)..(340): a, c, t, g, unknown or other
  misc_feature (340)..(340): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgccaccctaagtagtgagcatcgaacctacacatcgaatggtatcaacagagaccgagggaacgtcccccagtataataatagaaagttaagagtgatggacagaccacgaaccggaagggggacggactccccgatcgcttcagtggctcgagttcgngggctcgaccgctacctcccaccactcctacccaacctaccacgtctagacgagtgaggtctagatatcaacgtggaggagagacaccaacagtaagttgagttacgggaccaaggggggtacgggtttgggggttacggttaccgggggacgggaaggggaaccctaggtaccgttaccggtacccggttacccgttaaggggcccaaaccgggtccccgaaagggggtccccttacccgggaccccccgttcgggttcccttacccgtttcccgttcccgttaccccccctaacccgttccccgtacggttaccgttaaccgggttcgtaaccggg

SEQ ID NO: 347678 - DNA, 647 bp, Homo sapiens
  misc_feature: GZ8MTXP01BRC10.15.86.H09.1.454.CMB.2.raw
  modified_base (279)..(279): a, c, t, g, unknown or other
  misc_feature (279)..(279): n is a, c, g, or t
  modified_base (561)..(561): a, c, t, g, unknown or other
  misc_feature (561)..(561): n is a, c, g, or t
  modified_base (585)..(585): a, c, t, g, unknown or other
  misc_feature (585)..(585): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgccaccctaagtagtgagcatacgaacctacaccatcgaatggtatacaacagagaccgagggaacgtccccagtatataatagaaagtaagagtgangcacgaccacgacggaagggggacggactcccgatcgcttcgagtcggctcgtaggttcgtgggctcgaccgcctacctccacctactcctaccctaaccctccacgttcgtagacgagtggaggtcgtagacttatcgaacgttggagggaagacgacgaccaacaacgtaagttgaacgtcgggaaccgtaaaggggggttcgggggtttggggtcgttacgggggacggacggaaccgagtcgtacggtccgttacgtacggcaacggcccagggtccnccggtccccccgttgggttacccncgttcccgttcccggttccccccgcccgttcgtacccggttacgttaacggttaacgtccgg

SEQ ID NO: 347679 - DNA, 747 bp, Homo sapiens
  misc_feature: GZ8MTXP01DR1JF.15.86.H09.1.454.CMB.2.raw
  modified_base (295)..(295): a, c, t, g, unknown or other
  misc_feature (295)..(295): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagcttgggtttccttgctgctatacttaaaaggtgtccagtgtgaagtgcgaggtggtggagtcgtgggggagtccgttaggtaaacgccggtcgggggtcccttagacgtctctgtgtggcctgtgattcactttcagtaanggctggatgtaggttcgggtcccgcgaggccgtccggagggggacgggcgtgggaggttgggggttaggtaacgtttaaacgaaaaaagttaaaagtggtaagtagggtaagtaaaacgaaaaagtaacggaaccgttacgggtacggaaacccgtaaacccgggtaagggtaaaaaacgggtaacgtaacttaccaaaccgattacgtaacaaagagtaaaattaaactaaacgaaaaaaccggtggttagttaaagtttagaaacgtaaagaacgaacgaagtaacccgtaaagggaaaaacccggaggaacctaacgacgtaccctagttaaactactacgtaacctaagaagtagttaacggaagttcgaacgaacggttaacgaacggttaaaaggggcgttacttaagtgttctttagattacgtccgggttcggggtaaacccgg

SEQ ID NO: 347680 - DNA, 672 bp, Homo sapiens
  misc_feature: GZ8MTXP01DR5HA.15.86.H09.1.454.CMB.2.raw
  modified_base (228)..(228): a, c, t, g, unknown or other
  misc_feature (228)..(228): n is a, c, g, or t
  modified_base (337)..(337): a, c, t, g, unknown or other
  misc_feature (337)..(337): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaanagagaccagggaacgtccccagtatataatagaaagttaagagtgatggcagaccacgaaccggaagggggacggactccccgatcgtctcagtgggctcgtagttcgngggctcgaccgctacctccacctactccctacccaaccctcccgacgttcgtacgaaccgagtaggacggcgtagagttactcgactgggtagggagaagacgaccaacaactaagttagacgtcggaacccgtaagggggttacggggttgggggttacggttacggggacggggaacggggaaccgtaacggtccgtacgggtacccgtccgtaacgggtcgaaaccggtcccgaaagggtcccttcccggcccccgttcggttaccttaccgttcccgttcccgttacccccgtccccttccgtccgaccgtttaaccggaacgtaaccggg

SEQ ID NO: 347681 - DNA, 655 bp, Homo sapiens
  misc_feature: GZ8MTXP01CTI0U.15.86.H09.1.454.CMB.2.raw
  modified_base (457)..(457): a, c, t, g, unknown or other
  misc_feature (457)..(457): n is a, c, g, or t
  modified_base (578)..(578): a, c, t, g, unknown or other
  misc_feature (578)..(578): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacacatacgaatggtatacaacagagaccgagggactccccagtataataatagtaaagttaagagtgagtggacacgaccaacgaaccggaacgggggacggactaccccgatccgtcttacgagtcgggcctcgtagttcgcggggtcctcgaccgctaccctacccacctactcctacccaacctaccacgtcagaacgagtacggaggctaggagtaacttccgagttaggaggaacaacggacnccctaataacgaagttgacgtacgggacccgaaagggggttcggggttgggtagtcggggacggaaggaccctaggtcccgtagtacccgtctacgggcccaacggcccgagggttccccncccggtcccgtcgttaccgttccgttcccgttccccgtccccgtcccttacggtacgttaccgttaacggcgtaacg

SEQ ID NO: 347682 - DNA, 661 bp, Homo sapiens
  misc_feature: GZ8MTXP01CVKSU.15.86.H09.1.454.CMB.2.raw
  modified_base (268)..(268): a, c, t, g, unknown or other
  misc_feature (268)..(268): n is a, c, g, or t
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
  modified_base (309)..(310): a, c, t, g, unknown or other
  misc_feature (309)..(310): n is a, c, g, or t
  modified_base (312)..(312): a, c, t, g, unknown or other
  misc_feature (312)..(312): n is a, c, g, or t
  modified_base (324)..(324): a, c, t, g, unknown or other
  misc_feature (324)..(324): n is a, c, g, or t
  modified_base (333)..(333): a, c, t, g, unknown or other
  misc_feature (333)..(333): n is a, c, g, or t
  modified_base (557)..(557): a, c, t, g, unknown or other
  misc_feature (557)..(557): n is a, c, g, or t
  modified_base (594)..(594): a, c, t, g, unknown or other
  misc_feature (594)..(594): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcggctgagcttgggttttccttgctgctatcttaaaggtgtccagtgtgaagtgcgaggtggtggagtcgtgggggagccgttggtaaagccgtgggggtcctagagtctctgtgtgctctgntctacttnagtangntgntgngtggcncngcncgnggaggnngngtggtgagttanaaagtaaangagtgagaacgaaatagacgtacggtgaaccaaccgtaagaaagaagactacacactacacgaagtagaataataacgaaaaacggtacgttagttaactttagaaactaaagtacgaaacgaacgacccgtaaacggggaaaacccgagggaaaccaaccgacgtaccgttacttaacgttaaccgtaacgtaacccagtaacgtaacgttaacgggaaacgngtacgttacggtaaaccgggaacggttaaaaacgggngttacctaaggttagttaaccgttttaggactttaacgggttcccgggttaacgggggtaaccccgg

SEQ ID NO: 347683 - DNA, 691 bp, Homo sapiens
  misc_feature: GZ8MTXP01ES90R.15.86.H09.1.454.CMB.2.raw
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatggagttgggtccgcaggctccgaggggaagggctggagtgggttgtacgttacaaaagtaaatgatggagaagaaatagactacggtgacaccgtagaaagagatacacatctacaagagtaataattacgaaaaacgtcggttagtatttacgaactaaagtacgaaacacgaacccgtaacgaaaccgacggaacacgacgtaccgttactaacttactacgtaaccaacgtaagtacgttacggaaagttcgacgtaacgtaccgggaaagttaaagggaggtacttagttcggttattttaggacttacgtcggtcggggacccgtaggaactacgtggtcctcgtctccgttcgactcccgttacccaacggaaccgggttcccaccggttcccggtcccctttccccgcggcccctacccgttccctaaccgaacgtaacccg

SEQ ID NO: 347684 - DNA, 753 bp, Homo sapiens
  misc_feature: GZ8MTXP01C9E4O.15.86.H09.1.454.CMB.2.raw
  modified_base (278)..(278): a, c, t, g, unknown or other
  misc_feature (278)..(278): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcagggtggtggagtcgtggggggagccttgggtaaagccgtggggggtcccttagagtctcctgtgtggcctctggattcactttcagtaatggctggatgagttgggtccgcaggctcgagggagggctggngtgggtgacttanaaaagtaaangatgganaagaaatagataggtnacaccgtagaaaganatacacatactacaaagagtaataaacttaacgaaaaacgtacggttattaatttacgaactaaatagaaacacgtaacctaaaggaaaccgaggaaaccaacgacgtacccgtacttaacttaacctacgtaaccaactaaggtagttacggaagtacgactaagtaccgggaaaggtaaagggaggtacttagttcggttactttttaggaacttacggtccgggtacgggggaccccgtaagggggtaactaacgggttcggttccgtccggttcctttccgttacgacccggtaccccttacccgaaacccggtaaccgggggttcccccttacggttccccgggtttccccttaccccccggttcggaccccccttaccccgttaccctaacccgaaacggtaaccccg

SEQ ID NO: 347685 - DNA, 631 bp, Homo sapiens
  misc_feature: GZ8MTXP01DFZLX.15.86.H09.1.454.CMB.2.raw
  modified_base (335)..(335): a, c, t, g, unknown or other
  misc_feature (335)..(335): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacagggaactccccagtatataatagaaagttaagagtagatggacagaccaacgaaccggaaggggacggactccccgatcgctcagtggctcgtagttcgnggggctcgaccgctacctccaccatcctacccaacctccagtctagacgatgacgctgagtatcagtgaggagagacgacctaacaagtaattgaagtcggaaccgaaagggggtcggggtttaggggtcggttcgggacggaacggggaacacggacgtacggtaccgtcgttacggccaacggaccccgaagggtcccttccggccccccgttcggttacccgttccttcccgtttcccgggtccccccgtccccttcccggtccgttaccgttaaccggttaacgtaaccggg

SEQ ID NO: 347686 - DNA, 865 bp, Homo sapiens
  misc_feature: GZ8MTXP01EKACN.15.86.H09.1.454.CMB.2.raw
  modified_base (269)..(269): a, c, t, g, unknown or other
  misc_feature (269)..(269): n is a, c, g, or t
  modified_base (273)..(273): a, c, t, g, unknown or other
  misc_feature (273)..(273): n is a, c, g, or t
  modified_base (561)..(561): a, c, t, g, unknown or other
  misc_feature (561)..(561): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtcgtggggagccttggtaaagccgtgggggtcccttagagtctcctgtgtggcctctggattcactttcagtaatggctggatgagttgggtccgcaggctcgagggagggntggngtgggtgacgttacgaaaagtaaatgatggagaagaaatagactacggtgaccgaccggtagaaaggtaagattaccacactctacgaagaagtaattaaataacaaaaacgtacggttagttatttaggactaaaagtacgaaacacgtaaacccgtaaacgaaacccggacgaaaccgaacgacgtacccgttaacttaacttaacgttaccgtaaccaaaggtaacgtagtttaaccgggaagttacgaacgtaaacgttaccgggaaaggtttaaaaacggggngttaacgtttacgtttaggttttaacgttttaacggaacgttaccgttacccggggtaacccggggtaaaccccggtaaaggggttaaaccgttacgggttccgggtttccctttacccgtttccgtttaacccgttaacccggaccccggttaacccccgttaaacccggggaaacccgggttaacccccgggttaccccgtttaccgggtttaccccccggtttccccccgttacccccgggtaaccggttacccccccttaacccccgttaccccgttaaaacccggaaaccggtaacccg

SEQ ID NO: 347687 - DNA, 700 bp, Homo sapiens
  misc_feature: GZ8MTXP01EECZ5.15.86.H09.1.454.CMB.2.raw
  modified_base (293)..(293): a, c, t, g, unknown or other
  misc_feature (293)..(293): n is a, c, g, or t
  modified_base (623)..(623): a, c, t, g, unknown or other
  misc_feature (623)..(623): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctcgaggggaggggctggagtgggttggacgttanaaaagtaaaatgaatggagaagaaaatagaactacggtgaccaaccgtagaaaggaagtattacaaccatctacaaagagtaaattaaattaacaaaaaacggtacggttagttaactttacgactaaaatagaaacacgaaccctaaggaaacccgaggaaccaacgacgtacccgttactaattactagtaacccaacagtagttacgggaaatcggacagtacggaaacggtaaagggaggtcttaagttcggggttactttttaggaacttacgttcggtacgggggacccgtaaggggaactaggttcggtcgttcgtcttctcncgtcccttaccgaaccggacgggttccccttagttcccggtcccttccccgcgcccaccccttcctaaccgaagccg

SEQ ID NO: 347688 - DNA, 849 bp, Homo sapiens
  misc_feature: GZ8MTXP01C4CWX.15.86.H09.1.454.CMB.2.raw
tcagtctacgtagccacgaccggtgctcgatttagtgctatagacttgggtttgggggggacttccctggtctccttctacctactgcccttcattttctccacaggtctctgtgctctgcctgtgctgactcacgcccccgtctgcatctgccttgctgggagcctcgatcaagctcacctgccacctaagtagtgagcataccgaacctacacatacgaatgtatcaacagacgacgacggaccgtccccaagtataataagtagaaagtaagagtagagtggacacgaccaaccgaacggaaacgggggacggacctaccccggtatccgtctactaggtcggggacctccgtacggtttcggcggggtcgttcgacccgtacctaccctaccaacctactcctaaccctaaccctaaccgtacgttcgtaacgtaacggtacgtagggacggtacgtagggaaacttcttacccggaaacggtttgggggaacgggtaaagggaaaccgggaacccgtttaaccccaaaacgtaaacggtttaattacgggggaacgttaaccggggggaaacccccgtttaaaaggggggggggtttcccggggggtttggggggtttaacggtaccccggggggaacgggtaaaaacccgggggacccttaggtaccccgggtttacgaaaaccccccggggggttttacgtaaaccgggtaaccccgtaaccgggtaaccccggttacgggtttcccccgttaccccgggttacccccgttacgttaaccccgttccgttaccccgtccccgtacccctccgtccgaccggttacgtaacgggaacgtcggg

SEQ ID NO: 347689 - DNA, 824 bp, Homo sapiens
  misc_feature: GZ8MTXP01BUE4X.15.86.H09.1.454.CMB.2.raw
  modified_base (362)..(362): a, c, t, g, unknown or other
  misc_feature (362)..(362): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacgagggacgtccccagtatataatagaaagttaagagtgatggacacgaccacgaccggaagggggacggacgtccccgatcgtcttcgagtcggcctccgtaggttcgtgggggctcgaccgctaccnccccacctactccctacccgaaccctaccgacgtcgtacggaaccgtagttagggacggtcgtaggaacgttaacgtcgaacggttggacgggaaacggtacggaacggaccctaaactaaccggttaaagtttacgggaacggttacggggaaaccccgggttaaaggggggtttcccggggggttttagggggttaccgggtttacccggggggaacgggggtaaacccggggtaaacccggaacgggttacccgggttaccggtaaaccccgggttaccggtttaaacggggtacccggaacccgggaaccccggttaaaccggggtcccctttacccccgggccccccggtttaccggggttaaccccttccggttccccgtttcccccgggttaacccccctaacccgtttccccgtaccggttacccgttaaaccgggttccgggttaacccgggg

SEQ ID NO: 347690 - DNA, 640 bp, Homo sapiens
  misc_feature: GZ8MTXP01ECNYG.15.86.H09.1.454.CMB.2.raw
  modified_base (167)..(167): a, c, t, g, unknown or other
  misc_feature (167)..(167): n is a, c, g, or t
  modified_base (252)..(252): a, c, t, g, unknown or other
  misc_feature (252)..(252): n is a, c, g, or t
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (320)..(320): a, c, t, g, unknown or other
  misc_feature (320)..(320): n is a, c, g, or t
  modified_base (352)..(352): a, c, t, g, unknown or other
  misc_feature (352)..(352): n is a, c, g, or t
  modified_base (452)..(452): a, c, t, g, unknown or other
  misc_feature (452)..(452): n is a, c, g, or t
tcagtctacgtagccacgaccggtgctcgatttagtgctatagacttgggtttggggggaagaggaagactgacggtcccccaggagttcgggctgagctgggttttccttgctgctatcttaaaaggtgtccagtgtgaagtgcaggtggtggagtctgggggganccttggtaaagccgtggggggtcccttagagtctcctgtgtggcctctggattcacttcagtaatggctggatgagttgggtccncgagctcgagggagggctggagtgggtgacgttnaaagtaaangatggtanagaaactgactacggtnacaccgtgaaaaggtagattcaccatcctaanaagagtaataagtaaacgaaaacggtagtagtattacgaactaaagtacgaacacgaaaccgtaaagaaccgagtaacacgtacgtacctactatactanaacagtagtacgtacgaagtcatagtacgaacgtaagtagtacgtagtaggtacgttagtagtacgtacgtcggaccggacggacgtacgtgtcgtcgtcgtctcgacgtccgttaccgtaccgaccgaccgttccgttccgtcccgttcccgtcccgtccctacccttaccctaaccgaacgtaacg

SEQ ID NO: 347691 - DNA, 630 bp, Homo sapiens
  misc_feature: GZ8MTXP01B9THU.15.86.H09.1.454.CMB.2.raw
  modified_base (315)..(315): a, c, t, g, unknown or other
  misc_feature (315)..(315): n is a, c, g, or t
  modified_base (443)..(443): a, c, t, g, unknown or other
  misc_feature (443)..(443): n is a, c, g, or t
  modified_base (557)..(557): a, c, t, g, unknown or other
  misc_feature (557)..(557): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgcgtgggagcctcgatcaagctcacctgccaccctaagtagtgagcatacgaacctacaccatcgaatgtatacaacagagaccgagggaactccccagtataataagtagaaagttaagagtgatggacacgaccacgaaccggaagggggaccggacnccccgatcgcttcgagtggctcgtagttcggtgggctcgaccgtctaccgtccaccactcctacccacctaccagtcgtacgagagtgaggtctagagtatcgaacgttggaggagagaacgaccaanacgtaagttgagttcgggaaccgtaaggggggttcgggttggggtcgtcggggacgggaacggacaaggtccgtcgaaccggttccgagggtccaacgggtccaacggggtccncccggtacccctgggttacccttcgttcccgtcccgttaccccgccttccgtcgaccgtttaacgcggtaacg

SEQ ID NO: 347692 - DNA, 689 bp, Homo sapiens
  misc_feature: GZ8MTXP01EA93A.15.86.H09.1.454.CMB.2.raw
tcagtctacgtagccacgaccggtgctcgatttagtgctatagacttgggtttgggggggacttccctggtctccttctacctactgcccttcattttctccacaggtctctgtgctctgcctgtgctgactcacgcccccgtctgcatctgccttgcgtgggagcctcgatcaagctcacctgccaccctaagtagtgagcataccgaacctacaccatacgaatggtatcaacagagacgagggactccccagtatataatagaaagttaagagtgagtggacagccaacgacggaacgggggacggactcccgatcgtcttcgagtcggctcgtacgttcgtgggctacgaccgtctacctcccacctactccctacccaacccgtacctacgtcgtacgaacgtagtaggacgggcgtaggtacgttaatccgtaacgttgggagggaacgaaggaacccggacctaacaactaaggttagacgtacggacggtaaacggggggttgggggtttgggtccgggttacgggaacggggtacgaaccggagtccgtacggtaccccgttagtacggtaccgaacggacccggttacgtccgttcccggccccgttgggttccccttcgttccccgttccgttccccccggccttccggtccgttacggtaaccgttaagtcccgggg

SEQ ID NO: 347693 - DNA, 697 bp, Homo sapiens
  misc_feature: GZ8MTXP01AET2H.15.86.H09.1.454.CMB.2.raw
  modified_base (377)..(377): a, c, t, g, unknown or other
  misc_feature (377)..(377): n is a, c, g, or t
  modified_base (545)..(545): a, c, t, g, unknown or other
  misc_feature (545)..(545): n is a, c, g, or t
  modified_base (556)..(556): a, c, t, g, unknown or other
  misc_feature (556)..(556): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtcgtggggggagccttggtaaagccgtggggggtcccttagagtctcctgtgtggcctctggattcactttcagtaatggctggatgaggttcgggtccgccgaggctccgaggggaaggggcgtggaggtgggttggtacgttacaaaagtaaatgatggagaagaaatagacgtacggtgacgaccggtaggaaaggaagtattaccgaaccatctanaagagaattaactaacgaaaaacgtacggtagttagtttacgacgtaaatacgaaacacgaacccgtaacgaaaccggaggaaaccacgacggtccttacttaacttacgtacgaacctacgagtacgtacggaaagtcgaccgtagtacggaaacggtaaagcggtnttagtcggttntttacggattcgtcgggtcgggaccaggggtactaggtcgggtccttaccgtcttcgtacgccgtcccgaccgtaaccggacggttccccacggttcccggtccccttccccgcgacccctcccttctaaccgaagccccg

SEQ ID NO: 347694 - DNA, 686 bp, Homo sapiens
  misc_feature: GZ8MTXP01B3KDQ.15.86.H09.1.454.CMB.2.raw
  modified_base (290)..(290): a, c, t, g, unknown or other
  misc_feature (290)..(290): n is a, c, g, or t
  modified_base (324)..(324): a, c, t, g, unknown or other
  misc_feature (324)..(324): n is a, c, g, or t
  modified_base (341)..(341): a, c, t, g, unknown or other
  misc_feature (341)..(341): n is a, c, g, or t
  modified_base (487)..(487): a, c, t, g, unknown or other
  misc_feature (487)..(487): n is a, c, g, or t
  modified_base (640)..(640): a, c, t, g, unknown or other
  misc_feature (640)..(640): n is a, c, g, or t
  modified_base (660)..(660): a, c, t, g, unknown or other
  misc_feature (660)..(660): n is a, c, g, or t
tcagtctacgtagccacgaccggtgctcgatttagtgctatagacttgggtttgggggggaagaggaagactgacggtccccccaggagttcgggctgagctgggtttccttgctgctatcttaaaaggtgtccagtgtgaagtgcaggtggtggagtctggggggagccttggtaaagccgtggggggtcccttagagtctcctgtgtggcctctggattcactttcagtaatggctggatggagttgggtccgcaggctcgagggagggctggagtgggtgacgttanaaaagtaaatgatggagaagaaatagactaggtnacgaccgtagaaagganacttcacctatctacgaagtagtaactaaattaacgaaaaacggtacggttatagtttagaacctaaaagtacgaaactacgaaacccgtaaacggaaacccggaggaaccacgacgtccgttactaactttacacgtaacccaanagtacgttacggaagtcgactaacgtacgggaaacggttaaagggcgtctaaagttggtactttagatacgtccggtcggggacccaagggtaccaggttcgggtccttcggtccttcgtcgaccgcccttaccgaaccggaacggttccccngttccccggtccttccccgngacccctcccgttctaaccgaagtcg

SEQ ID NO: 347695 - DNA, 678 bp, Homo sapiens
  misc_feature: GZ8MTXP01ACGQH.15.86.H09.1.454.CMB.2.raw
  modified_base (292)..(292): a, c, t, g, unknown or other
  misc_feature (292)..(292): n is a, c, g, or t
  modified_base (301)..(301): a, c, t, g, unknown or other
  misc_feature (301)..(301): n is a, c, g, or t
  modified_base (326)..(326): a, c, t, g, unknown or other
  misc_feature (326)..(326): n is a, c, g, or t
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
  modified_base (384)..(384): a, c, t, g, unknown or other
  misc_feature (384)..(384): n is a, c, g, or t
  modified_base (409)..(409): a, c, t, g, unknown or other
  misc_feature (409)..(409): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctgtattcactttcagtaatggctggatggagttgggtccgccaggctaccgagggaagggctggagtgggtgacgttanaaagtaaangatggagaagaaatagactacggtnacaccgtagaaagganattcacntactacaagagaataattacgaaaacgtacggttntatttacgactaaagtacgaaaccngaacccgtaagaaacccggagggtaacccacgtacgtccgtactaacgttactacggtaaccacgtagtacgttacggaagtggacctaagtacgaaacggttaaagcggtacttagtggttacgttttgaacttcgtccgggtacggggaccaaggggtaaccttaggtcgggtccttacgttctaacgttccacgtccccttacgaaccgtacgggccccttgttccccgtcccttccccaagccctacccgttccaacgaagcccg

SEQ ID NO: 347696 - DNA, 587 bp, Homo sapiens
  misc_feature: GZ8MTXP01DNY3C.15.86.H09.1.454.CMB.2.raw
  modified_base (427)..(427): a, c, t, g, unknown or other
  misc_feature (427)..(427): n is a, c, g, or t
  modified_base (536)..(536): a, c, t, g, unknown or other
  misc_feature (536)..(536): n is a, c, g, or t
  modified_base (549)..(549): a, c, t, g, unknown or other
  misc_feature (549)..(549): n is a, c, g, or t
  modified_base (564)..(564): a, c, t, g, unknown or other
  misc_feature (564)..(564): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatacaacagagaccgagggaacgtccccagtaatataatagaaagtaagagtgatgcagccacgacgaaggggacggactcccgatcgctcagtggctcgagttcgtcgggctcgaccgctacctaccaccactcctcccaaacctccacgtcgtagaccgagtgacgcgtgagtactgacgtgggagagaacgacgtacccaanactaattacggacttagggaccccgtaaagggggttcgggttgggggtgttaccgggaggggaccggtacaaggtcgtacgccgtacgtacggcaacgacccgagtccnccgcccctggacncttcgtcctaccccnccgtctcgacttaacgaagtccg

SEQ ID NO: 347697 - DNA, 602 bp, Homo sapiens
  misc_feature: GZ8MTXP01AB6Y2.15.86.H09.1.454.CMB.2.raw
  modified_base (330)..(330): a, c, t, g, unknown or other
  misc_feature (330)..(330): n is a, c, g, or t
  modified_base (552)..(552): a, c, t, g, unknown or other
  misc_feature (552)..(552): n is a, c, g, or t
  modified_base (565)..(565): a, c, t, g, unknown or other
  misc_feature (565)..(565): n is a, c, g, or t
  modified_base (582)..(582): a, c, t, g, unknown or other
  misc_feature (582)..(582): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacagggaactcccccagtatataatgaaagttaagagtgatggcagccacgaccgaagggggacggactccccgatcgctcagtggctcgagttcgnggggctcgaccgctacctcccacctatcctacccaacctcccgagttctgaccgagtcgaacggtcgtggtaatactacaccgttggacggaagagacgtaccaacaactaaagttgaacgttcgggaccgaaagggggtcggggtttggggttacggtaccggggacggacgggaccgaaaggtccgtacggaccgtcgtaacggcaacgccaagggtccncgccccctggccncttctaacccggtcccncctcgcgctaacgaagtccg

SEQ ID NO: 347698 - DNA, 760 bp, Homo sapiens
  misc_feature: GZ8MTXP01BHB5L.15.86.H09.1.454.CMB.2.raw
  modified_base (283)..(283): a, c, t, g, unknown or other
  misc_feature (283)..(283): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcataccgaacctacaccatacgaatggtatacaacagacgaccgagggaaccgtccccagtaatataatagaaagtagagtgagngacagaccaacgaaccggaacgggggacggaccgtccccgagtcgtacctcgagtcgggtccgtcgtacggtttcgtcgggggtcctacgacccgtcctaccctacccgaccctaactccctacccaacccgtaccctacgttcgtacggtaaccgtaagttacggtacggtacgttacggtaacgttactccgaaggttggagggaagaacgtaccgacgtaaacaacgttaagttacggaacgtcgggtaacccggtaaggggggtaacggggttttgggggtacgggttaccggggacgggtaacggggaaccgtaaggaccggttaccggacccggttacggtaacggtcccggaaacgtccccggaaaggtccccgttcccggtccccggtcggttacccttaccgtttcccgtccccggttacccctcccgttcccgttaccgttaccggttccgggttaacgtaaccggg

SEQ ID NO: 347699 - DNA, 860 bp, Homo sapiens
  misc_feature: GZ8MTXP01A0WB3.15.86.H09.1.454.CMB.2.raw
  modified_base (253)..(253): a, c, t, g, unknown or other
  misc_feature (253)..(253): n is a, c, g, or t
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttggtccncagctcgagggagggntggagtgggtgacttanaaagtaaatgatgganaagaaatagactacggnacgaaccgtagaaaaggagacttacaacctaatactacgaaagaagtaaataaacttaaaccgaaaaaacggtcggttaagttaatttaccggaactaaaagtcgaaacgtacgaaacccgtaaacgaaaccggaggaaaccaacgtacggtacccgttacttaacgtttaacctacgtaaaccaacgtaaggtaacgtttaccggaaaggttacgaaccgtaaacgttaccgggaaaacggttaaaacgggacgggtacctttaagttacgggggtttaacttttttaagggaacgtttaaccggtacccggggttaaacgggggacccccgtaaaagggggtaaacccttaacgggttccggggttcccggtttaacccggtttccgtttaaaccctttcccgaaaccggttcccccttaaacccggaaaacccgggacccgggttaccccgttacgtttcccccgggttaaccccctttccccccggtaacggacccccttaacccccgttacccgttaacccgaaaacgggtccccg

SEQ ID NO: 347700 - DNA, 681 bp, Homo sapiens
  misc_feature: GZ8MTXP01AKIOC.15.86.H09.1.454.CMB.2.raw
  modified_base (258)..(258): a, c, t, g, unknown or other
  misc_feature (258)..(258): n is a, c, g, or t
  modified_base (362)..(362): a, c, t, g, unknown or other
  misc_feature (362)..(362): n is a, c, g, or t
  modified_base (639)..(639): a, c, t, g, unknown or other
  misc_feature (639)..(639): n is a, c, g, or t
  modified_base (660)..(660): a, c, t, g, unknown or other
  misc_feature (660)..(660): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatacgaacctacaccatacgaatggtatacaacagagacgaggacgtccccagtatanaatagaaagttagagtgatggacacgccaacgaaccggaagggggacggactccccgagtcgactcagtcgggcctaccgtagtttcggtcggggctacggccncctaccctaccccacctactccctaccccgtaaaccctacccgtacgtcgtacggaaccgggagttacggacggtaccgtagggtaacgttactacggtaccgttagggagggaacgaacgtaaccggacccaaacaacgttaagttagaacggttcggaaccggaacggggggttacggggtttcgggggtaggttccggggacgggacggaccgtaagtccgtacgtacccgtcgtacgccaacgtcccgaggcccttccggccccgtgttaccncgttcgtaacccgttcccccnccgtcgcgttacgtcgcgtcg

SEQ ID NO: 347701 - DNA, 677 bp, Homo sapiens
  misc_feature: GZ8MTXP01BINAH.15.86.H09.1.454.CMB.2.raw
  modified_base (271)..(271): a, c, t, g, unknown or other
  misc_feature (271)..(271): n is a, c, g, or t
  modified_base (422)..(422): a, c, t, g, unknown or other
  misc_feature (422)..(422): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatacgaatggtatacaacagagacagggactccccagtatataatagaaagtaagagngatggcagccacgaccgaagggggacggactccccgatcgcttcagtggcctctagttcgtggggctcgaccgctacctcccaccatcctacccaaccctccacgtctacgaaccgtagtaggacggtcgtgtagtactccgaagttgggngggaaagaggtaaccgaccccttaaagaacgtaagtacgtacgtaccgggtaaccggtaaggggggtttcgggggttcggggtacggggtaccggggaacggggaacggaaccggtacggtccggtacggtacccggtacggtaccggcgaaccgggacccgacgggtcccgccccggtccccggtacgttcccttccgttcccgttccccgtacccccttcccttccgtccggttaccgtaacggttaacggcg

SEQ ID NO: 347702 - DNA, 647 bp, Homo sapiens
  misc_feature: GZ8MTXP01C1ZTI.15.86.H09.1.454.CMB.2.raw
  modified_base (451)..(451): a, c, t, g, unknown or other
  misc_feature (451)..(451): n is a, c, g, or t
  modified_base (485)..(485): a, c, t, g, unknown or other
  misc_feature (485)..(485): n is a, c, g, or t
  modified_base (618)..(618): a, c, t, g, unknown or other
  misc_feature (618)..(618): n is a, c, g, or t
tcagtctacgtagccacgaccggtgctcgatttagtgctatagacttggggtttgggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggccgccaggctcgagggagggctggagtgggtggacgttacaaaagtaaaatgatggagaagaaaatagacgtacggtgacaccgtagaaaggagacttcaccatctacaagagaataattacaaaaacgtcggtatatttacgacaaatgaaacagaaccctaagaaaccgaggaacacagccgtatatactgtaaccanagtattacggaatgacagtacggaacgtaaaggngtactagtggtcttttgaattacgtccggtcgggggacccaaggggtaaccaggttcgggtccttcgttcttccttcgacgtcccttaccgaaaccgacgggccccttagttccccggtcccttaccccccgnggcccctaccccgttcctaaccgaagccg

SEQ ID NO: 347703 - DNA, 690 bp, Homo sapiens
  misc_feature: GZ8MTXP01C1ZCV.15.86.H09.1.454.CMB.2.raw
  modified_base (226)..(226): a, c, t, g, unknown or other
  misc_feature (226)..(226): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgccacctaagtagtgagcatacgaacctacaccatcgaatggtanacaacagacgacgagggaactccccagtataataatagtaaagtaagagtagagtggacacgaccgaacgaaccggaacgggggacggaccgtaccccgagtcgtctcgagtcggctcgtagtttcggcgggctcgaccgcctacctaccccacctactcctaccccgaaccctaccgacgtcgtacggaccgagtacggacggtcgtaggaagtactacgcgttagggaggaacggagaacgaccaaacgtaacaaggttacgaaggtacggtaaccggtaaggggggtttaacggggtttcggggttacgggttaccggggaccggggtaacgggaccgaggtcccgtacggtaccgttacggacgtcgaaccggaccgacggtccgcccgtaccccgtggttacccttcgttacccgttcccggtcccctccctccggtaccgttccgttaacggcgtcgg

SEQ ID NO: 347704 - DNA, 607 bp, Homo sapiens
  misc_feature: GZ8MTXP01DLHJG.15.86.H09.1.454.CMB.2.raw
  modified_base (341)..(341): a, c, t, g, unknown or other
  misc_feature (341)..(341): n is a, c, g, or t
  modified_base (436)..(436): a, c, t, g, unknown or other
  misc_feature (436)..(436): n is a, c, g, or t
  modified_base (602)..(602): a, c, t, g, unknown or other
  misc_feature (602)..(602): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatggtatcaacagagacgacgggaacgtccccagtataataatagaaagttaagagtgatggcacgaccacgaaccggaagggggacggactccccgatcgcttcagtggctcgtagttcgngggctcgaccgctacctccaccactcctacccaccctccacgtctcgacgtagtaggacggcgtagagtactcgacgttgggaggaagacggaanaccaacaacgtaagttgagtacgggaccgtaaagggggtcggggtttggggttacggtcgggacggacgggaccaagcgtcggtaccgtcgtacggcaacggcgacggtccttccgtccccgtgttaccttcttccgtcccggtccctccctacgtcgcgtaacgngtccg

SEQ ID NO: 347705 - DNA, 680 bp, Homo sapiens
  misc_feature: GZ8MTXP01CG97U.15.86.H09.1.454.CMB.2.raw
  modified_base (433)..(433): a, c, t, g, unknown or other
  misc_feature (433)..(433): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatacgaacctacaccatcgaatggtatacaacagacgacgagggaacgtaccccagtatataagtagtaaagtaagagtgagtgcagaccacgacggaacgggggacggacgtcccgatcgtctcgagtcggctcgtagttcgtgggctcgaccgctaccgtccccacctactcctacccaaccctaccacgtcgtacgacgtagtggacggtcgtagtagtactcgagtaggngggaagagacgaccaactaacgtaagttcgaacggttacgggaccggtaaacgggggtcgggggtttaggggtacggttccggggacgggaaccgggacaaggtccgtacggaccccgtacggtacggccgaaccgcccgttaacgggccttccggtacccccgtggttaccccttcttccccggttaaccctcccccccgtaacccgttcccgtaccggttacccgttaacggttaacgtcccggg

SEQ ID NO: 347706 - DNA, 707 bp, Homo sapiens
  misc_feature: GZ8MTXP01BN9ET.15.86.H09.1.454.CMB.2.raw
  modified_base (308)..(308): a, c, t, g, unknown or other
  misc_feature (308)..(308): n is a, c, g, or t
  modified_base (445)..(445): a, c, t, g, unknown or other
  misc_feature (445)..(445): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcacgcccccgtctgcatctgccttgctgggagcctcgatcaagctcacctgacaccctaagtagtgagcatacgaacctacaccatcgaatggtatacaacagagaccgagggacgtccccagtataataatagaaagtaagagtgatgcacgccacgacggaagggggacggacncccgatcgctcgagtggctcgtaggttcgtcgggctcgaccgtcctacctccccacctactccctacccaaccctccgaacgtcgtagaccgtagtcggaacggtcgtagtaagttactccgaagttgggagggaanaacggacgacccaagtaacgtaagttagacgtacgggaccgtaagggggggttacgggggtttgggggtacggtaccgggggacggggaaccggggtaaccctaaggtccgttacggaccccggttacgttacggccgaaccggtcccgaacgggtcccttcccggcccccgtttcggttccccgttaccttccccgttaaccccggttccccccaacccggtttccccgtccggaccgttaaccgggttaaccgaaccggg

SEQ ID NO: 347707 - DNA, 779 bp, Homo sapiens
  misc_feature: GZ8MTXP01C6GJT.15.86.H09.1.454.CMB.2.raw
  modified_base (585)..(585): a, c, t, g, unknown or other
  misc_feature (585)..(585): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgcgaggctcgagggagggcgtggagtgggtggtacttaacgaaaagtaaaatgatggagaaagtaaaatagaacgtacggtcgaccgaaccgtaggaaaaggtagtaattaccaccatactacaaagtaagtaaataaacgttaaccgaaaaaaacggtacggttagttaacgtttacgaactaaaagtcgaaacgtacgaaacccgttaaaggaaacccgtagggaaccctaaacgacgtacccgttacttaaacgttacctacgtaacccaacgtaaggtacgtttaccgggaaagtacgactaacgtaacggaaacggttaaaaagggngtaaccttaagttgggtttactttttaggaacttacggttcggtaccgggggacccgtaagggtaaacctaaggttcgggttaccgtcgttcgttaacctcgaacgtccccgaaccgtaaccgacgggccccttcgttaccccgggtccccttaccccgtggacccctccccttacctaaccgaacgtaacccg

SEQ ID NO: 347708 - DNA, 680 bp, Homo sapiens
  misc_feature: GZ8MTXP01A7TEI.15.86.H09.1.454.CMB.2.raw
  modified_base (588)..(588): a, c, t, g, unknown or other
  misc_feature (588)..(588): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcacgcccccgtctgcatctgccttgcgtgggagcctcgatcaagctcacctgcacctaagtagtgagcataccgaacctacaccatacgtaagtggtactacaacgagagaaccgaagggtaacccgtacccccaagtaactaataaatacgaaaaggttaagagtagagtcggacacgaccacgaaccggaaggggggaccggtaccgccccgagtccgtcttacgagtcggaccttcgacgttcggtcggggtctacgccgtactacccacctaccactcctaccctacccgtaccagttcctagaccgtagtcggacgtcgtacggtatacgttacaggttggaggaggacgaacgacctaacaacgtaagtacgtagtacggaccgtaaggggggtggtttcggggcggttacggggacggaccggaacgacgtacgtcgtaccgttaccgngtcccgaactccggagtcccgccgtcccgtaacggttccttaccgttccgttcccggtcccctccgtaccgtcgccgtaacgcgtaaccggg

SEQ ID NO: 347709 - DNA, 691 bp, Homo sapiens
  misc_feature: GZ8MTXP01EV8TB.15.86.H09.1.454.CMB.2.raw
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (644)..(644): a, c, t, g, unknown or other
  misc_feature (644)..(644): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagcttgggttttccttgctgctatcttaaaaggtgtccagtgtgaagtgcaggtggtggagtcgtgggggagccgttggtaaacgccgtgggggtccttagagtctctgtgtgctctgntctacttcagtanggctggatgaggttcggtccgcgaggccgtcgagggaggggcgtggaggtgggttaggacgtttaagaaaaagtaaaatgaagtaggtagaaagaaaagtagacgtaacggacgaacccgaacccgtaaggaaaagggtaaagtacttaccgaacctatactacgaaagaagtaaattaaaacgttaacgaaaaaacggtacggttaagttaatttacggaaactaaagtacgaaacgtacgaaccgtaaacggggaaaacccgaaggaaccacgaacgtcccgttataacgttactaacggtacccaacgtaagtactaacgggtaagttacggaccaagtaccggaaaggttaaaggngttaccttaagtcgttcgtttagattcgtcggttcggggtaacccgg

SEQ ID NO: 347710 - DNA, 704 bp, Homo sapiens
  misc_feature: GZ8MTXP01EFNXA.15.86.H09.1.454.CMB.2.raw
  modified_base (523)..(523): a, c, t, g, unknown or other
  misc_feature (523)..(523): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctcgtggattcactttcagtaatggctggatgagttgggtccgccgaggctccgaggggaagggcgtggaggtgggttaggtacgtttacaaaagtaaaatgagtggagaagaaagtagacgtacggtgaccgaccgtaggaaaggagatacaccatctacaagagaataacgttacaaaacggtgtagttatttacgacaaagtagaacacgtaacccgtaaagaaaccggaggaaccacgacgtccctatacttacgacgtaaccacgtaaggattacggaaagtcgactaagtccggaaagtaaagggngtacttagttggtttacgttagacgtacggtccgggtaccgggaccgaagggtactaggttccgggttccgttccgtcttaaccgttcgacccgtacccgaccgaaccggtacccggttcccgttccggttccccgttcccctcccgccgtaccccaccccgttacctaaccgaacgtccg

SEQ ID NO: 347711 - DNA, 592 bp, Homo sapiens
  misc_feature: GZ8MTXP01AM5XI.15.86.H09.1.454.CMB.2.raw
  modified_base (259)..(259): a, c, t, g, unknown or other
  misc_feature (259)..(259): n is a, c, g, or t
  modified_base (414)..(414): a, c, t, g, unknown or other
  misc_feature (414)..(414): n is a, c, g, or t
  modified_base (431)..(431): a, c, t, g, unknown or other
  misc_feature (431)..(431): n is a, c, g, or t
  modified_base (477)..(477): a, c, t, g, unknown or other
  misc_feature (477)..(477): n is a, c, g, or t
  modified_base (487)..(487): a, c, t, g, unknown or other
  misc_feature (487)..(487): n is a, c, g, or t
  modified_base (557)..(557): a, c, t, g, unknown or other
  misc_feature (557)..(557): n is a, c, g, or t
  modified_base (589)..(589): a, c, t, g, unknown or other
  misc_feature (589)..(589): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcataccgaacctacaccatacgaatggtatacaacagagacgagggacgtccccagtatanaatagtaaagttaagagtgatggcagccacgacggaagggggcggactcccgatcgtcttcagtcggctcgtagttcgtaggggcctcgaccgctacctccccaccactcctacccaaccctccctagttccagaccgagtacgaggctgacgtntcaagtggaggagacgnaccaatacattgactagggccaagggggttcggtgggtgtacgggngaacgggccngttacgccgaccgttgacggccgaacgtcccaaggtccccttcgtacccccgttggacccttacgttccnccttcccccaacgtttcgccacgttaaccggngcg

SEQ ID NO: 347712 - DNA, 732 bp, Homo sapiens
  misc_feature: GZ8MTXP01A25UC.15.86.H09.1.454.CMB.2.raw
  modified_base (636)..(636): a, c, t, g, unknown or other
  misc_feature (636)..(636): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggacgcctcgatcaagctcacctgccaccctaagtagtgagcatcgaacctacaccatcgaatggtatacaacagacgaccgagggaacgtccccagtataataagtagaaagttaagagtagatggcacgaccgacgaaccggaagggggacggaactccccggatccgtcttaccagtcgggtctcgtagttcggtggggacttcgacccgtactacctacccaacctacttccctaccttaaccctaccgtacgtcgtacggaccgtagtcgaacgggtctaggtaccttaatcccgaggttagggtacggaagacgaaccgccctaaacagttaaattcgggaacgttacgggaacccgtaaaggggggtcggggtttggggtacggttcgggggaaggtaaccgggacctaaggcgtaaccgggtaccccgtcggtaacgggtccaaacccgggtcccgaaagggttccccncccgggtcccccgttcggttacccgttccgtttcccgttaaccccggtccccgtaacccgttccccggacgttaccggtaacgggttcgaaccggg

SEQ ID NO: 347713 - DNA, 677 bp, Homo sapiens
  misc_feature: GZ8MTXP01DHUWH.15.86.H09.1.454.CMB.2.raw
  modified_base (391)..(391): a, c, t, g, unknown or other
  misc_feature (391)..(391): n is a, c, g, or t
  modified_base (445)..(445): a, c, t, g, unknown or other
  misc_feature (445)..(445): n is a, c, g, or t
  modified_base (509)..(509): a, c, t, g, unknown or other
  misc_feature (509)..(509): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgccgaggctccgagggagggctggaggtgggtggacgtttacaaaagtaaaatgatggagaagaaatagaactacggtgacaccgtagaaaggaagacttcacctatctacaagagaataatacgaaaaacgacggtnttaagttcgacaaatgaacagaacctaagaaacgagaacacagccgtatatacngtaaccactagtacttacgggaatggactaagtacggaaacggttaaaaggacgggtattaagnggtttacgtttttagaaacttgtacggtaccgggggacccttaggggaaacctaaggttggtccgtcgttcttcctcacggtcccttacgaaccgaaccggggttaccccttggttaccccgttccctcccccgtggtccccaccccttcgaaccgttaacgggcccg

SEQ ID NO: 347714 - DNA, 725 bp, Homo sapiens
  misc_feature: GZ8MTXP01CHX30.15.86.H09.1.454.CMB.2.raw
  modified_base (294)..(294): a, c, t, g, unknown or other
  misc_feature (294)..(294): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgtagttgggtccgccgaggctcgagggagggctggagtgggttgtacgttanaaaagtaaatgatggagaagaaatagacgtacggtcgacgaccgtaggaaaggaagtattacacatctacaagtagaaataagtaacaaaacgtacggtattaatttacgactaaagtacggaaacacgaaacccgtaaacggaaacccggaggaaacctaccgacgtacccgttactacttaactacgtaacccagtaagtacgttacgggaaagtcgtacgtaagtaccgggaaaggttaaaagggacggtactttaaggttggggtttcgtttttaagaaacgttcgtttcggaccggggtacccgaaggggtacctaagttcggggttctaccgttctcttcgacgtccccttaccgaaaccgcggggttccccttgttccccggttccttccccgtaagccctaccccttcgtaacccgaagcccg

SEQ ID NO: 347715 - DNA, 748 bp, Homo sapiens
  misc_feature: GZ8MTXP01BNCX4.15.86.H09.1.454.CMB.2.raw
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatccgaacctacaccatcgaatggtatacaacagagaccgagggaactcccccagtatataatagaaaagttaagagtgatggacacgaccgaaccgaaccggaaggggggacgggactccccgagtccggtcttcgagtcggggctcgtaggttcggtggggctacgacccgtcctacctacccacctatccctacccaacccgtaccacgtcgtagacgaatggacggtctagaacggttactcgtaacgtgggtagggaagacgaacgaccctaacgaacgaaagtttgaaacggttcgggaaccctaaaaggggggggttacgggggttttgggggtcgggttaccgggggaccgggggaaggggaaaccccgttaaggaccgttccggaaacccggttcccggtaaacgggtccgaaacccgggacccaaacgggggtcccttacccggccccccccggttaggttaccccgttcccttccgtttaaccccggtccccccctaaccttccccggtcgttacccggttaacgttaacgtaaccgg

SEQ ID NO: 347716 - DNA, 681 bp, Homo sapiens
  misc_feature: GZ8MTXP01A7GFV.15.86.H09.1.454.CMB.2.raw
  modified_base (298)..(298): a, c, t, g, unknown or other
  misc_feature (298)..(298): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctggggggagccttggtaaagccgtggggggtcccttagagtctcctgtgtggcctctggattcactttcagtaatggctggatgagttgggtccgccaggctccgaggggaaggggctgggagtggggttggacgttanaaaagtaaaatgataggagaagaaaatagactacggtgacaccgtagaaaggaagattacaccatctacaagagaataatacaaaaacgcggtagtattgacaaatgaacagacctaagaaaccgaggaaccacacgtccgtactattactcgtaaccacaagacgttacggaagtgacagtaccggaaacggttaaagggacggtacttagtcgggttcttttaggattacgtcggtcgggggaccccgtaaggggaactaaggttcgggtacgttccgttcttcgttcacggtccccttaccgaaaccggaaccgggccccttacgttcccgggtcccttccccccgtggccccaccccgttacctaacccgaagaacccg

SEQ ID NO: 347717 - DNA, 933 bp, Homo sapiens
  misc_feature: GZ8MTXP01C2S8G.15.86.H09.1.454.CMB.2.raw
  modified_base (276)..(276): a, c, t, g, unknown or other
  misc_feature (276)..(276): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgcgtgggagcctcgatcaagctcactgcacctaagtagtgagcatacgaacctacacatcgaatggtatacaacagagacgagggaactccccagtatataaagtagaaagtaagagtagacnggacacgacaacgaccggaagggggacggactaccccgatccgtcgtacgagtcggctaccgtagtttcgcggggtctacggacctactacctcccaaccactacctacccaaaccctctacgttccgtagaccgagttacgaagggtctagggaactttacgtccgaaacggttgggacgggggaactttaaggggaacccgaaccccgttttaaaaacgtaaacggttaaacggttacgggtaaaccgggttaacccgggggttaaaccggggtttaaaacggggggggggtttaccggggggttttacggggggtaacccgggggttaacccggggggaaaacccgggggtaaaccggggtaaaccccggtttaaacggggttaccccggttaacccgggggttaaacccccgggttaaccggggttaaaccgggtaaccccgggtaaaccccgggtaaccccggggttaacccgggttccccccgggtttacccccggggttacccccccgggtttaacgggtttacccccgttaccccgggttaccccccggttttcccccggggttaccccccccggttaaccccggtttaaaccccggggtacccgggttaaaccccggggttaaccgggttaacccgggtaaccggggg

SEQ ID NO: 347718 - DNA, 774 bp, Homo sapiens
  misc_feature: GZ8MTXP01CMEES.15.86.H09.1.454.CMB.2.raw
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (301)..(301): a, c, t, g, unknown or other
  misc_feature (301)..(301): n is a, c, g, or t
  modified_base (355)..(355): a, c, t, g, unknown or other
  misc_feature (355)..(355): n is a, c, g, or t
tcagtctacgtagccacgaccggtgctcgatttagtgctatagacttgggtttggggggaagaggaagactgacggtccccccaggagttcgggctgagctgggtttccttgctgctatcttaaaaggtgtccagtgtgaagtgcaggtggtggagtctggggagccttggtaaagccgtggggggtcccttagagtctcctgtgtggcctcgtggattcacttcagtaatggctggatgagttcgggtccgcaggctcgagggaagggctggagtgggtgtacgttanaaagtaaanganggtagacgaaaatgacgtacggtcgacaccgtagaaacggagactcacatctanaagacgaataacgttacaaaagtacggtatacgttagacaaagtgaacacgactaacgaacgacgtaacacacgcccgtagtactacgttacgaaccacgagttagtaccggtaaagtcgtaccgaagttaaccgggaaccggtaaaagggtccgggtattaacgtacggggttacccgttttttagggaacttagggtttaccccggtacggggggaccccctaagggggttaaaccccgtaaaggttccggggtttaacccgtccggtttaccgttttaacccgaccgttaacccgtttaccccgacccgaaacccggttaaacccggggccttaaccccggttttcccggtaacccccttaccccccggtggtaccccgacccccgttaccgtttaaccccgaaggggttaacccg

SEQ ID NO: 347719 - DNA, 691 bp, Homo sapiens
  misc_feature: GZ8MTXP01AG4G4.15.86.H09.1.454.CMB.2.raw
  modified_base (420)..(420): a, c, t, g, unknown or other
  misc_feature (420)..(420): n is a, c, g, or t
  modified_base (470)..(470): a, c, t, g, unknown or other
  misc_feature (470)..(470): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatccgaacctacaccatcgaatgtatacaacagacgaccgagggaacctccccagtatataatagaaagtagagtgatggacacgccgacgaaccggaagggggaccggactcccgagtaccgtcttcgagtcgggactcgtaggttcggtacggggtcctcgaccgtcgtacctcccacctactcctacccaccctaccacgttcgtagacgtatacggnggtacgtcgtaggttacacgtacgttggggacgaaggacggacacccaanaacgtagttaggagtacccgggagtaaagggggggtcgggtttcggggtacgttccgggggacggtaacgggaccgaaggtcccgttcgggtaaccccgtccgttaaaggcccgaaaccggccggttaacgggtcccttacccggtcccccgttaggccttaccgttcccgtttccccgggtaccccgtcccctcgtcggacctttaacggaacgtccggg

SEQ ID NO: 347720 - DNA, 800 bp, Homo sapiens
  misc_feature: GZ8MTXP01BBHYE.15.86.H09.1.454.CMB.2.raw
  modified_base (293)..(293): a, c, t, g, unknown or other
  misc_feature (293)..(293): n is a, c, g, or t
tcagtctacgtagccacgaccggtgctcgatttagtgctatagacttgggtttgggggggaagaggaagactgacagtcccccccaggagttcgggctgagctgggttttccttgctgctatcttaaaaggtgtccagtgtgaagtgcaggtggtggagtcgtgggggagccttggtaaagccgtgggggggtcccttagagtctcctgtgtggcctctggattcactttcagtaatggctggatgagttggtccgccaggctcgagggagggctggagtgggttgacgttanaaaagtaaatgagtggtagaagaaatagactacggtgcacccggtagaaaggagattacaccatactacaaagagaattaaattaacgaaaaaacggtacgggttagttaattttacggaactaaaacgtcgtaaaaccgaacggtacccgttaacgggaaaaaacccgacggggaaccaaccgacggtaccccgttacttaaactttaacctacgtaaaccccaacgtaaggtaacgtttacggggaaagttgaccctaaggtaaccggaaacggttaaaagggacggtaccttaaggttacgttacgtttttagaacgttacgtccggtacgggggtaccccgaaggggtaaaccctaggttccgggtccggttcgttccttccgtttacccgaccggttcccctaaacccgaaccccggttaaaccggggttcccccttaaggttccccgggttacccctttcccccgcggacccccttacccccgttcccaacccgaaaccgg

SEQ ID NO: 347721 - DNA, 610 bp, Homo sapiens
  misc_feature: GZ8MTXP01DN6BF.15.86.H09.1.454.CMB.2.raw
  modified_base (342)..(342): a, c, t, g, unknown or other
  misc_feature (342)..(342): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgacaaccctaagtagtgagcaatacgaacctaacaccatcgaatgtatacaacagagaccgaggaacgtccccagtataataatagaaagttaagagtgatggcacgaccaacgaaccggaaagggggacggactccccgatcgctcagtggctcagttcgnggggctcgaccgctacctccaccatccaccaacctcagtctagacgatgaggctagagtatcatgaggaacagacggaccaactaacgtaattagactagggacccgaaagggggtacggggtttggggtccggttaggggacgggaacgggaacaagcctaggaccccgtacgtcggacaacggtaacccaagggtccttcgccccccgttggacccttacgttctcccggttacccctcccgtcgtacgacgtaacgttaagaacg

SEQ ID NO: 347722 - DNA, 654 bp, Homo sapiens
  misc_feature: GZ8MTXP01BZWT3.15.86.H09.1.454.CMB.2.raw
  modified_base (260)..(260): a, c, t, g, unknown or other
  misc_feature (260)..(260): n is a, c, g, or t
  modified_base (308)..(308): a, c, t, g, unknown or other
  misc_feature (308)..(308): n is a, c, g, or t
  modified_base (317)..(317): a, c, t, g, unknown or other
  misc_feature (317)..(317): n is a, c, g, or t
  modified_base (411)..(411): a, c, t, g, unknown or other
  misc_feature (411)..(411): n is a, c, g, or t
  modified_base (631)..(631): a, c, t, g, unknown or other
  misc_feature (631)..(631): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatggtatacaacagagaccgagggaacgtaccccagtataanaatagaaagttaagagtgatggcagaccacgacgaagggggacggacncccgatcgntcagtcggctcgtagttcgtcgggctcgaccgctacctccccaccatcctaccaaccctaccgaagtcgagacgagtggaggtcgtagtaagtncgtaacgttggagggagacgaacgacccaacaaacgttaagttcggaagtacgggaacccctaaagggggggtcggggttttgggggtcgttacggggaacggggtaacgggaactacggaccgttcggaacccgttcgaacggtcaaaccggtcccgaaaggtcccttaccgccccccgtggttcccttacgttcccgtccgttcccccaaccgttccnggttaccttaacggaagtccggg

SEQ ID NO: 347723 - DNA, 514 bp, Homo sapiens
  misc_feature: GZ8MTXP02F9U7J.15.86.H09.1.454.CMB.2.raw
  modified_base (398)..(398): a, c, t, g, unknown or other
  misc_feature (398)..(398): n is a, c, g, or t
  modified_base (426)..(426): a, c, t, g, unknown or other
  misc_feature (426)..(426): n is a, c, g, or t
tcagtctacgtagccacgaccggtgctcgatttagtgctatagacttgggtttggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaaggggacggatccccgatcgcttcatgggctccagttctggggctgaccgctacctccaccatctccaacctccagtctgacgatgagctgagtatcactgtggagagagccanacaattgatggccaaaggacggttgggngttcgggcggagggaccaagctgaccgtctaggtcagcccaaggctgccccctggtcactctgttccccacctcctcgctacgtagac

SEQ ID NO: 347724 - DNA, 526 bp, Homo sapiens
  misc_feature: GZ8MTXP02HUV6S.15.86.H09.1.454.CMB.2.raw
  modified_base (401)..(401): a, c, t, g, unknown or other
  misc_feature (401)..(401): n is a, c, g, or t
  modified_base (437)..(437): a, c, t, g, unknown or other
  misc_feature (437)..(437): n is a, c, g, or t
  modified_base (513)..(513): a, c, t, g, unknown or other
  misc_feature (513)..(513): n is a, c, g, or t
tcagtctacgtagccacgaccggtgctcgatttagtgctatagacttgggtttggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaaggggacggatccccgatcgcttcatgggctccagttcgtggggctgaccgctacctccaccatctccaacctccagtctgacgatgagctgagtatcactgtggagagagccaanacaaattgaatgggaccaaaggtacgggtttggggngttcgggcggagggaccaagctgaccgtcaggtcacgcccaaggctcgccccctggcactctcgttccccgcctcncgctacgtagacg

SEQ ID NO: 347725 - DNA, 622 bp, Homo sapiens
  misc_feature: GZ8MTXP02HO0I3.15.86.H09.1.454.CMB.2.raw
  modified_base (297)..(297): a, c, t, g, unknown or other
  misc_feature (297)..(297): n is a, c, g, or t
  modified_base (448)..(448): a, c, t, g, unknown or other
  misc_feature (448)..(448): n is a, c, g, or t
tcagtctacgtagccacgaccggtgctcgatttagtgctatagacttgggtttgggggaagaggaagactgacggtccccccaggagttcgggctgagcgtgggttttccttgctgctatacttaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggaaggggctgggagtggggttggacgtttanaaaagtaaaatgatggtagaagaaaatagactacggtgcacccgtgaaaggagattcaccatctcaagagataattacaaaaacgacggtgtatttgacaaatgaacagcctagaaaccgaggacacacgccgtctattactgtacccaanagtagtacgaagtgacagtacgaacggtaaaggagtacttagtgttctttagttatagtacgtcgggaccggacggacgtacgtacggtcgtcgtcttctctacgtcctaccaccgaccgaccgtaccgtccgtcccgttccccgtccgtccctaccctaccctaccgacgacg

SEQ ID NO: 347726 - DNA, 519 bp, Homo sapiens
  misc_feature: GZ8MTXP02HQC2B.15.86.H09.1.454.CMB.2.raw
  modified_base (327)..(327): a, c, t, g, unknown or other
  misc_feature (327)..(327): n is a, c, g, or t
  modified_base (404)..(404): a, c, t, g, unknown or other
  misc_feature (404)..(404): n is a, c, g, or t
  modified_base (431)..(431): a, c, t, g, unknown or other
  misc_feature (431)..(431): n is a, c, g, or t
  modified_base (439)..(439): a, c, t, g, unknown or other
  misc_feature (439)..(439): n is a, c, g, or t
  modified_base (516)..(516): a, c, t, g, unknown or other
  misc_feature (516)..(516): n is a, c, g, or t
tcagtctacgtagccacgaccggtgctcgatttagtgctatagacttgggtttggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacggatccccgatcgcttcatgggctccagttcnggggctgaccgctacctccaccatcctccaacctccagtctgacgatgaggctgagtatcactgtggagagagccanacaattgatggccaaggcggtttgggngttcgggngagggaccagctgaccgtcaggcagcccaaggcctgccccctgcacgtctcgttccccgcctcctacgcctacgtanacg

SEQ ID NO: 347727 - DNA, 519 bp, Homo sapiens
  misc_feature: GZ8MTXP02IWRIC.15.86.H09.1.454.CMB.2.raw
  modified_base (399)..(399): a, c, t, g, unknown or other
  misc_feature (399)..(399): n is a, c, g, or t
  modified_base (426)..(426): a, c, t, g, unknown or other
  misc_feature (426)..(426): n is a, c, g, or t
  modified_base (506)..(506): a, c, t, g, unknown or other
  misc_feature (506)..(506): n is a, c, g, or t
tcagtctacgtagccacgaccggtgctcgatttagtgctatagacttgggtttggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaaggggacggatccccgatcgcttcatggctccagttctggggctgaccgctacctccaccatctccaacctccagtctgacgatgaggctgagtatcactgtggagagagcccanacaattgatggccaaaggcggttgggngttcgggcggagggaccaaggctaggaccgtctaggtcacgcccaaggctcgcccctcggcactctcgtccccgcctccncgctacgtagacg

SEQ ID NO: 347728 - DNA, 556 bp, Homo sapiens
  misc_feature: GZ8MTXP02G0DBB.15.86.H09.1.454.CMB.2.raw
  modified_base (402)..(402): a, c, t, g, unknown or other
  misc_feature (402)..(402): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaaggggacggatccccgatcgcttcatgggctccagttctggggctgaccgctacctccaccatcctccaacctccagtctgacgatgagctgagtatcactgtggagagagccanacaattgatggaccaaggcgggtttggggtgttcggggcggaagggacccaaggctacggacccgttccgtagggtccaacggccccgaaagggtcctcggcccccctcgggtccacgtcctcgttccccgccctcctcgcctacggtagaccg

SEQ ID NO: 347729 - DNA, 532 bp, Homo sapiens
  misc_feature: GZ8MTXP02H8Q7J.15.86.H09.1.454.CMB.2.raw
  modified_base (274)..(274): a, c, t, g, unknown or other
  misc_feature (274)..(274): n is a, c, g, or t
  modified_base (386)..(386): a, c, t, g, unknown or other
  misc_feature (386)..(386): n is a, c, g, or t
  modified_base (399)..(399): a, c, t, g, unknown or other
  misc_feature (399)..(399): n is a, c, g, or t
  modified_base (442)..(442): a, c, t, g, unknown or other
  misc_feature (442)..(442): n is a, c, g, or t
  modified_base (530)..(530): a, c, t, g, unknown or other
  misc_feature (530)..(530): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatagaaagttaagagtganggcagcacaaccgaaggggacggatccccgatcgctcatggctccagttctggggctgaccgctacctccaccatctccaacctccagtctgacatgagctgagtatcatgnggagagagccaanaactaaattgaatgggaccaaaggacgggtttgggtgtcgggnggaagggaccaagctgaccgtctaggcagcccaaggcctggcccccctggccactcgtcgttccccaccctcctcgacctacggtacncg

SEQ ID NO: 347730 - DNA, 517 bp, Homo sapiens
  misc_feature: GZ8MTXP02JYA4C.15.86.H09.1.454.CMB.2.raw
  modified_base (434)..(434): a, c, t, g, unknown or other
  misc_feature (434)..(434): n is a, c, g, or t
  modified_base (503)..(503): a, c, t, g, unknown or other
  misc_feature (503)..(503): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaaggggacggatccccgatcgcttcatggctccagttctggggctgaccgctacctccaccatctccaacctccagtctgacgatgagctgagtatcactgtggagagagccacacaattgatggccaaggacggttgggtgttcgggnggaggaccaagctgaccgtcaggtcacgcccaggctcggccccctggtccactctcgttcccacctccncgctacgacgtacg

SEQ ID NO: 347731 - DNA, 524 bp, Homo sapiens
  misc_feature: GZ8MTXP02GWQ1B.15.86.H09.1.454.CMB.2.raw
  modified_base (431)..(431): a, c, t, g, unknown or other
  misc_feature (431)..(431): n is a, c, g, or t
  modified_base (511)..(511): a, c, t, g, unknown or other
  misc_feature (511)..(511): n is a, c, g, or t
  modified_base (521)..(521): a, c, t, g, unknown or other
  misc_feature (521)..(521): n is a, c, g, or t
tcagtctacgtagccacgaccggtgctcgatttagtgctatagacttgggtttggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaaggggacggatccccgatcgcttcatgggctccagttctggggctgaccgctacctccaccatctccaacctccagtctgacgatgaggctgagtatcactgtaggagagagccacaacaattgatggaccaaaggacggttgggngttcgggcggagggaccaagctaggaccgtcgtaggcacgcccaaggcctcgccccctcgcactctcgttccccgcctcncgctacgtanacg

SEQ ID NO: 347732 - DNA, 644 bp, Homo sapiens
  misc_feature: GZ8MTXP02IZ5ZB.15.86.H09.1.454.CMB.2.raw
  modified_base (417)..(417): a, c, t, g, unknown or other
  misc_feature (417)..(417): n is a, c, g, or t
  modified_base (460)..(460): a, c, t, g, unknown or other
  misc_feature (460)..(460): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtcccccagtatataatagaaagttaagagtgatggcagccacaccgaaggggacggatccccgatccgcttcagtgggctccgagttcgtggggctgaccgctacctccaccatctccaacctcagtctgacgagtgaggctgagtactcgactggtacggaagagacgcccaaanaactaaattgattacgggaccaaagggtacggggttttagggngttccgggggacgggaaggggacccaaaggtcctacggaccccgttacgtaagggtcccaacgggacccccaaagggggtcccttacgggccccccccgttaggggtacccctaaccgttccgttccggtttaccccccaacccctttcccgtaccggtacccgtttaaccggttagtaaccgg

SEQ ID NO: 347733 - DNA, 674 bp, Homo sapiens
  misc_feature: GZ8MTXP02HCT4X.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcacgccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggatccccgatcgcttcatgggctcagttcgtgggctgaccgctacctcccaccactcctaccaacctccagtctgacgatgaggctgagttatccacgttggtagggagaagacgacccaacaactaaagttggaagtcgggaccctaaagggtaccgggggtttggggtcggtttaccgggggacggaacgggggaacccaaagggcccgtagggtaacccccggttaccggttaaggggtcccaaaacggtcccccggaaaaggggtccccttccccgggaccccccccgtttggggtacccacccgtttcccgttccgggtttcccccccgcccccgttcccggtacccgtacccgtttaaccggtacgtaccg

SEQ ID NO: 347734 - DNA, 516 bp, Homo sapiens
  misc_feature: GZ8MTXP02GW4J5.15.86.H09.1.454.CMB.2.raw
  modified_base (387)..(387): a, c, t, g, unknown or other
  misc_feature (387)..(387): n is a, c, g, or t
  modified_base (433)..(433): a, c, t, g, unknown or other
  misc_feature (433)..(433): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtccgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaaggggacggatccccgatcgcttcatggctcagttctggggctgaccgctacctcaccccatctccaacctccagtctgacgatgagctgagtatcactgnggagagagccacacaattgatggaccaaggacggttgggtgtcggnggaggaccagctgaccgtcaggtcagcccaggctcgcccctggtccactctcgtccccacctccgtcgctacgtacgactcgg

SEQ ID NO: 347735 - DNA, 513 bp, Homo sapiens
  misc_feature: GZ8MTXP02JZVV2.15.86.H09.1.454.CMB.2.raw
  modified_base (392)..(392): a, c, t, g, unknown or other
  misc_feature (392)..(392): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaaggggacgggatccccgatcgcttcatgggctccagttctggggctgaccgctacctccaccatctccacctccagtctgacgatgagctgagtatcactgtgganagagccacacaattgatggccaaggacgggttggtgttcgggcggaggaccagctgaccgtcaggtcagcccaggctcgccccctggtcactctcgttccccgcctcctcgctacgtagac

SEQ ID NO: 347736 - DNA, 557 bp, Homo sapiens
  misc_feature: GZ8MTXP02F25DE.15.86.H09.1.454.CMB.2.raw
  modified_base (403)..(403): a, c, t, g, unknown or other
  misc_feature (403)..(403): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaaggggacggatccccgatcgcttcatgggctcagttctggggctgaccgctacctccaccatctccaacctccagtctgacgatgaggctgagtatcactgtggagagagcccaanacaatgatggacaaggtacgggttgggtggtcgggacggaacgggaccaaggcgtacggacccgtcgtaggtcacgcccgaaggcctccgcccccgtcggtccaccgttccgtcccggttcccccgccctaccctccgtacctaccgtacgacg

SEQ ID NO: 347737 - DNA, 576 bp, Homo sapiens
  misc_feature: GZ8MTXP02H4KHV.15.86.H09.1.454.CMB.2.raw
  modified_base (438)..(438): a, c, t, g, unknown or other
  misc_feature (438)..(438): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggacgtcccccagtatataatagaaagttaagagtgatggcagccacaccgaaggggacggatccccgatcgcttcagtgggctccagttcgtggggctgaccgctacctccaccatctccaacctccacgtctgacgatgagctgagtactcacgtgtggagagacgccaacacaattgatggaccaaggacgggtttgggngtcgggcgggaggacccaaggctacggaccgtcgtacggtcacgaccccgaagggccctccggccccccgtcggtcctaccgttccgttaaccgttcccccaaccccttcccgtaccgtccgttaacggtacggaccg

SEQ ID NO: 347738 - DNA, 636 bp, Homo sapiens
  misc_feature: GZ8MTXP02J1NFQ.15.86.H09.1.454.CMB.2.raw
  modified_base (402)..(402): a, c, t, g, unknown or other
  misc_feature (402)..(402): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaagggggacggactccccgatcgcttcatgggctccagttcgtggggctgaccgctacctccaccatcctccaacctccagtctgatgatgaggctgagtatcacgtgtggganaggacgcccaacactaaattggatcgggacccaaagggtccggggtttgggggtcggtttaccggggacggggaacgggggaacccaaaggtccgttacggaaccccggttcccgtaaggggtacccacgggcccccgaaaggggtccctccgggccccccccttggggtccctaccgttcccgttcccgggtttcccccccgcccccgttccgtccggtaccgttacggtacg

SEQ ID NO: 347739 - DNA, 524 bp, Homo sapiens
  misc_feature: GZ8MTXP02GYHFB.15.86.H09.1.454.CMB.2.raw
  modified_base (403)..(403): a, c, t, g, unknown or other
  misc_feature (403)..(403): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
  modified_base (511)..(511): a, c, t, g, unknown or other
  misc_feature (511)..(511): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaaggggacggatccccgatcgcttcatgggctccagttctggggctgaccgctacctccaccactctccaacctccagtctgacgatgagctgagtatcactgtggagagagccaanacaatgatggccaaggacggttgggngttcgggnggagggaccaagctgaccgtctaggcagcccaaggctcgccccctcggtccacgtctcgttccccacccgtccncgctacgtagacg

SEQ ID NO: 347740 - DNA, 678 bp, Homo sapiens
  misc_feature: GZ8MTXP02IUXNC.15.86.H09.1.454.CMB.2.raw
  modified_base (403)..(403): a, c, t, g, unknown or other
  misc_feature (403)..(403): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaaggggacggatccccgatcgcttcatggctccgagttctgggctgaccgctacctcaccatctccaacctccagtctgacgatgagctgagtatcacgtgtcggagagacgccanacaattcgattcgggaccctaaagggtaccgggtttggggtcgtttaccgggggacgggtaacgggaccctaaagggtcccgttacgggaaccccggtttcccgtaagggggttacccaacgggtaccccccgtaaaagggggtccccttaaccggggacccccccccgtttgggggtacccctaacccgtttcccgtttaacccggtttaccccccctaaaccccgtttcccggttacccggtacccgtttaaaccgggttacggtaaccccgg

SEQ ID NO: 347741 - DNA, 520 bp, Homo sapiens
  misc_feature: GZ8MTXP02J31EQ.15.86.H09.1.454.CMB.2.raw
  modified_base (439)..(439): a, c, t, g, unknown or other
  misc_feature (439)..(439): n is a, c, g, or t
  modified_base (477)..(477): a, c, t, g, unknown or other
  misc_feature (477)..(477): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccaggaagtcccccagtatataatgaaagttaagagtgatggcagccacaccgaaggggacggatccccgatcgcttcatgggctccagttctggggctgaccgctacctccaccatctccaacctccagtctgacgatgaggctgagtatcactgtggagagagccaacacaaattgatgggaccaaggacgggttgggtgtcgggnggaggaccaagctgaccgtctaggcacgcccaaggccncgccccctgccactctcgttccccacctcctcgcttacgagcg

SEQ ID NO: 347742 - DNA, 570 bp, Homo sapiens
  misc_feature: GZ8MTXP02G7OKQ.15.86.H09.1.454.CMB.2.raw
  modified_base (408)..(408): a, c, t, g, unknown or other
  misc_feature (408)..(408): n is a, c, g, or t
  modified_base (531)..(531): a, c, t, g, unknown or other
  misc_feature (531)..(531): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggatccccgatcgcttcatgggctcgagttcgtgggctgaccgctacctccaccatctccaacctccagtctgacgagtgagctgagtatcacgttgaggagagacgcctaanaactaagttcgacgtcggaccaaagggtcggggtttgggcgttccggggacggagggggacccaaggcgtacggacccgtccgtaggtccaacgccccgaagggcctcggccccctggtaccncgttcgccgttccccacctccgtcggccttacggacgcg

SEQ ID NO: 347743 - DNA, 583 bp, Homo sapiens
  misc_feature: GZ8MTXP02HUIG0.15.86.H09.1.454.CMB.2.raw
  modified_base (435)..(435): a, c, t, g, unknown or other
  misc_feature (435)..(435): n is a, c, g, or t
  modified_base (469)..(469): a, c, t, g, unknown or other
  misc_feature (469)..(469): n is a, c, g, or t
tcagtctacgtagccacgaccggtgctcgatttagtgctatagacttgggtttggggaagaggaagactgacggtcccccaggagttcgggctgagcgtgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcaccgtgaaaggaagattcaccatctcaaagagataaattacaaaaaacgacggtgtaatttgcaaaatgaaacagccctagaaaccgaggaacacagccgtctattacngtaccacagattcggaagtgcatcgacgtaaagngctatgctttgtatatcgtgggccgacggacgaagtgtcgtcgtctcttctacgcctccaccacggaccgactccggtccgttccccttccggcccaccctccctaccacgacg

SEQ ID NO: 347744 - DNA, 532 bp, Homo sapiens
  misc_feature: GZ8MTXP02I3OFZ.15.86.H09.1.454.CMB.2.raw
  modified_base (400)..(400): a, c, t, g, unknown or other
  misc_feature (400)..(400): n is a, c, g, or t
  modified_base (529)..(529): a, c, t, g, unknown or other
  misc_feature (529)..(529): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaaggggacggatccccgatcgcttcatggctccagttctggggctgaccgctacctccaccatctccaacctccagtctgacgatgaggctgagtatcactgtggagagagccanacaattgatgggaccaaggacgggtttgggagttcgggacgggagggaccaagctagaccgtcccaggtcacgcccgaaggcctcgccccctcggccacgtctcgttccccgcctcctacgctacgtanacg

SEQ ID NO: 347745 - DNA, 530 bp, Homo sapiens
  misc_feature: GZ8MTXP02I3Z64.15.86.H09.1.454.CMB.2.raw
  modified_base (441)..(441): a, c, t, g, unknown or other
  misc_feature (441)..(441): n is a, c, g, or t
tcagtctacgtagccacgaccggtgctcgatttagtgctatagacttgggtttgggggacttccctggtctccttctacctactgcccttcattttctccacaggtctctgtgctctgcctgtgttgactcagccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaaggggacggatccccgatcgcttcatggctccagttcgtggggctgaccgctacctcaccccatcctccaacctccagtctgacgatgagctgagtatcactggtggagagagccacacaattgatggaccaaaggtcggttgggtgttcgggngggagggaccaagctggaccgtcgtaggcacgcccaaggcctcgccccctgtcacgtctcgtaacccgccctcacgctacgtagactgg

SEQ ID NO: 347746 - DNA, 568 bp, Homo sapiens
  misc_feature: GZ8MTXP02FR0NJ.15.86.H09.1.454.CMB.2.raw
  modified_base (402)..(402): a, c, t, g, unknown or other
  misc_feature (402)..(402): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacggatccccgatcgcttcatgggctcagttctggggctgaccgctacctccaccatctccaacctccagtctgacgatgaggctgagtatcactgtggagagagccanactaattgattgggacccaaaggtacggggtttggggtagttcgggggacgggaaggggacccaaaggccgttaggaacccgtccgtaaggtccaagcccccgaaagggcctcgcccccctggtccacttcctcgttccccaaccctcctccgactacgtacgacg

SEQ ID NO: 347747 - DNA, 522 bp, Homo sapiens
  misc_feature: GZ8MTXP02FOTHB.15.86.H09.1.454.CMB.2.raw
  modified_base (406)..(406): a, c, t, g, unknown or other
  misc_feature (406)..(406): n is a, c, g, or t
  modified_base (443)..(443): a, c, t, g, unknown or other
  misc_feature (443)..(443): n is a, c, g, or t
  modified_base (493)..(493): a, c, t, g, unknown or other
  misc_feature (493)..(493): n is a, c, g, or t
  modified_base (511)..(511): a, c, t, g, unknown or other
  misc_feature (511)..(511): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctccatcaagctcacctgcaccctaagtagtgagcatcgaacctacaccatcgaatggtatcaacagagaccagggaagtccccccagtatataatgaaagttaagagtgatggcagccacaccgaagggggacggatccccgatcgcttcatgggctccagttctggggctgaccgctacctccaccatctccaacctccagtctgacgatgaggctgagtatcactgtaggagagagcccaanacaattgatggccaaaggtcgggttgggtgttcgggnggagggaccaagctgaccgtctaggcagcccaggctcgccccctggtccnctctccgtccccacctcncgctacgagcg

SEQ ID NO: 347748 - DNA, 520 bp, Homo sapiens
  misc_feature: GZ8MTXP02FPL1T.15.86.H09.1.454.CMB.2.raw
  modified_base (400)..(400): a, c, t, g, unknown or other
  misc_feature (400)..(400): n is a, c, g, or t
tcagtctacgtagccacgaccggtgctcgatttagtgctatagacttgggtttggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaaggggacggatccccgatcgcttcatgggctccagttctggggctgaccgctacctccaccatctccaacctccagtctgacgatgaggctgagtatcactgtggagagagccanacaattgatgggccaaagacggttgggtgttcgggcggagggaccaagctgaccgtcctaggtcagcccaaggctgccccctcggtcacgtctcgttcccgccctctcgctacgtagacg

SEQ ID NO: 347749 - DNA, 571 bp, Homo sapiens
  misc_feature: GZ8MTXP02JYCRQ.15.86.H09.1.454.CMB.2.raw
  modified_base (409)..(409): a, c, t, g, unknown or other
  misc_feature (409)..(409): n is a, c, g, or t
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
  modified_base (465)..(465): a, c, t, g, unknown or other
  misc_feature (465)..(465): n is a, c, g, or t
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgaagaaaatagactacggtgcacccgtgaaaggagattcaccatctcaagagataattacaaaaacgcggtgtatttgcaaatgaacagcctagaaaccgnggacacagccgtctattacngtaccanagattcggaaagtgcatcgacgtaaaggngctatgctttgatatcgtggggcccaggggacaagtggtcgtcgtctcttcagccctacaccaacgggcccagtcggtcctcccccgtggccacccctcaccagcg

SEQ ID NO: 347750 - DNA, 749 bp, Homo sapiens
  misc_feature: GZ8MTXP02HY0ZH.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatagaaagttaagagtgatggcagccacaccgaaggggacggatccccgatcgctcatggctcagttcgtggggctcgaccgctacctccaccatctccaacctccagtctgacgatgagctagagtactcacgttggtagggagaagacgaccctaacgaactaaatttggaattaggggaacccctaaaaggggtaccgggggtttttgggggtacgggtttacccggggggaccggggtaaagggggaaacccccaaaaggggtcccgttacgggggaaacccccgtttccccgggtaaaagggggttaccccaacgggtacccccccgaaaaggggggtccccctttaccccggggaccccccccccggtttacgggggttccccctaaacccggttttcccccgttaacccgggtttttccccccccaaaccccccggttttccccgttaccggtacccccgtttaaaaccgggtttaaccggacccgg

SEQ ID NO: 347751 - DNA, 522 bp, Homo sapiens
  misc_feature: GZ8MTXP02HPGLR.15.86.H09.1.454.CMB.2.raw
  modified_base (392)..(392): a, c, t, g, unknown or other
  misc_feature (392)..(392): n is a, c, g, or t
  modified_base (400)..(400): a, c, t, g, unknown or other
  misc_feature (400)..(400): n is a, c, g, or t
  modified_base (425)..(425): a, c, t, g, unknown or other
  misc_feature (425)..(425): n is a, c, g, or t
  modified_base (492)..(492): a, c, t, g, unknown or other
  misc_feature (492)..(492): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttagagtgatggcagccacaccaaggggacggatccccgatcgcttcatgggctccagttctggggctgaccgctacctccaccatctacccaacctccatctgacgatgaggctgagtatcatgtgganagagccanacaatgatggaccaaagcggttggngttcgggacgagggacctaagctgaccgtcctagcacgcccaaggcctcgccccctggtccacgtcncgttcccaccctcctcgcctacgtacgacg

SEQ ID NO: 347752 - DNA, 577 bp, Homo sapiens
  misc_feature: GZ8MTXP02GJ6V2.15.86.H09.1.454.CMB.2.raw
  modified_base (414)..(414): a, c, t, g, unknown or other
  misc_feature (414)..(414): n is a, c, g, or t
tcagtctacgtagccacgaccggtgctcgatttagtgctatagacttgggtttgggggaagaggaagactgacggtcccccaggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaagggctggagtgggttggacgtttcaaaagtaaaatgatggtgagaaaatagactacggtgcacccgtgaaaggaagattcaccatctcaaagagataaattcaaaaaacgacggtagtatttgacaaaatgaaacagccctagaaaccgnggaacacagccgtctattactgtaccacagattcggaagtgcatcgaacgtaaagaggactatgcttttgattatctgggggcccaggggacaatggtcgtcgtctcttcagccctcaccaacggcccatccggtcttcccccgtggccaccctctccaagac

SEQ ID NO: 347753 - DNA, 571 bp, Homo sapiens
  misc_feature: GZ8MTXP02JUSLG.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacggatccccgatcgcttcatgggctccagttctggggctgaccgctacctccaccatcctccaacctccagtctgacgatgagctgagtatcactggtggagagagcccaacacaattgatgggccaaagggcggggttgggtggttcgggcgggaagggaccaaggctacggacccgttccgtaagggtccacggccccgaaagggccctcggcccccccgtggtcccacgtccgttcgttcccccggccctaccgtccgaccgttaccgtagaccg

SEQ ID NO: 347754 - DNA, 593 bp, Homo sapiens
  misc_feature: GZ8MTXP02GVGGO.15.86.H09.1.454.CMB.2.raw
  modified_base (392)..(392): a, c, t, g, unknown or other
  misc_feature (392)..(392): n is a, c, g, or t
tcagtctacgtagccacgaccggtgctcgatttagtgctatagacttgggtttgggggacttcccgtggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacacgaaggggacggatccccgatcgcttcatggctcagttcgtggggctgaccgctacctcccaccatctccaacctccagtctgacgatgagctgagtatcactgnggagagagccaatacaaagttgatcgggaccaaagggtcgggtttggggtcgttcggggacgggaagggaacccaaggccgtaggacccgttcgtaaggggtccaacggaccccgaaaggggcccttccggacccccccgttgggtacccaacttccgtcgtttcccccggaacccttccgtacgcttaccggtataccgg

SEQ ID NO: 347755 - DNA, 559 bp, Homo sapiens
  misc_feature: GZ8MTXP02IT645.15.86.H09.1.454.CMB.2.raw
  modified_base (387)..(387): a, c, t, g, unknown or other
  misc_feature (387)..(387): n is a, c, g, or t
  modified_base (394)..(394): a, c, t, g, unknown or other
  misc_feature (394)..(394): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacggatccccgatcgcttcatgggctccagttcgtggggctgaccgctacctccaccatctccaacctccagtctgatgatgagctgagtancactggnggagagacgccaagacattgatcggaccaaaggtcgggttggggtcggttcgggacgggagggaccaaggctacggaccgtcgtagggtcaacggcccgaaagggcctcggcccccgtggtccacgtcgttccgttccccgccctaccgtcgaccttacggtacg

SEQ ID NO: 347756 - DNA, 538 bp, Homo sapiens
  misc_feature: GZ8MTXP02JZ47U.15.86.H09.1.454.CMB.2.raw
  modified_base (408)..(408): a, c, t, g, unknown or other
  misc_feature (408)..(408): n is a, c, g, or t
  modified_base (534)..(534): a, c, t, g, unknown or other
  misc_feature (534)..(534): n is a, c, g, or t
tcagtctacgtagccacgaccggtgctcgatttagtgctatagacttgggtttgggggacttcccgtggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaaggggacggatccccgatcgcttcatgggctccagttcgtggggctcgaccgctacctccaccatcctaccaacctccagtctgacgatgagctgatatcactggtggagagagcccaanaactaattgatcgggaccaaaggtacggggttgggtagttcggggacggtagggacccaagctagaccgtctaggcacgcccaggctcgccccctggcactctcgttccccgcctcctcgctacgnaccg

SEQ ID NO: 347757 - DNA, 530 bp, Homo sapiens
  misc_feature: GZ8MTXP02FYZP6.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaaggggacggatccccgatcgcttcatgggctccagttctggggctgaccgctacctccaccatctccaacctccagtctgacgatgagctgagtatcactgtggagagagccacacaattgatggaccaaggacggttgggtgttcgggcggagggaccaagctgaccgtcctaggcagccccaaggcctcgccccctcggtccacgttctcgttccccaccctcctccgctacgtagacg

SEQ ID NO: 347758 - DNA, 565 bp, Homo sapiens
  misc_feature: GZ8MTXP02G8VX9.15.86.H09.1.454.CMB.2.raw
  modified_base (547)..(547): a, c, t, g, unknown or other
  misc_feature (547)..(547): n is a, c, g, or t
tcagtctacgtagccacgaccggtgctcgatttagtgctatagacttgggtttgggggaagaggaagactgacggtcccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttggtccgccaggctccagggaagggctggagtgggttggacgtttcaaaagtaaaatgatggtgagaaatagactacggtgcacccgtgaaaggaagattcaccatctcaagagataattcaaaaaacgacggtagtatttgacaaaatgaaacagcctagaaacccgaggacacagccgtctattactgtaccacagattcggaagtgcatcgaacgtaaaggaggctatgcttttgatatctggggcccaggggacaagtggtcgtcgtctcttcagcctcaccaggcccatcggtctccccnggccacctcctccagacg

SEQ ID NO: 347759 - DNA, 630 bp, Homo sapiens
  misc_feature: GZ8MTXP02JOQYR.15.86.H09.1.454.CMB.2.raw
  modified_base (450)..(450): a, c, t, g, unknown or other
  misc_feature (450)..(450): n is a, c, g, or t
  modified_base (463)..(463): a, c, t, g, unknown or other
  misc_feature (463)..(463): n is a, c, g, or t
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtggggttggacgtttacaaaagtaaaatgatggtgaagaaaatagactacggtgcacccgtagaaaggagattcacatctacaagagataattacaaaaacgacggtagtatttacgactaaatagaaacagacctagaaaccgagaacacagccgtactattactgtaccanagattcggaagtnacatacgaacgtaaaggagactatgtacttttagattagtcgtcgggggacccaggggacaagttggtacgtcgtcttcgttcacgccctaccgaacccgaacggggccccacgttcccggttcccttccccccgtggacccctacccctccctaccgaacgtaccg

SEQ ID NO: 347760 - DNA, 610 bp, Homo sapiens
  misc_feature: GZ8MTXP02HS1HU.15.86.H09.1.454.CMB.2.raw
  modified_base (387)..(387): a, c, t, g, unknown or other
  misc_feature (387)..(387): n is a, c, g, or t
  modified_base (400)..(400): a, c, t, g, unknown or other
  misc_feature (400)..(400): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacagggaagtcccccagtatataatgaaagttaagagtgatggcagccacaccgaaggggacggatccccgatcgctcatgggctccagttcgtggggctgaccgctacctccaccatctccaacctccagtctgacgatgagctgagtatcatgnggagagagccaanacaattgaatgggacccaaggtacgggttgggtgttacggggacgggaggggaacccaaggccgtacggacccgttccgtaaggggtcccaacggcccccgaaaaggggcccttccgggcccccccttcggggtacccaaccgttcccgttaaccgtttccccccgaaccccctttcccgtcccgtccgtttaaaccggttaacgacccg

SEQ ID NO: 347761 - DNA, 655 bp, Homo sapiens
  misc_feature: GZ8MTXP02IZ5OW.15.86.H09.1.454.CMB.2.raw
  modified_base (416)..(416): a, c, t, g, unknown or other
  misc_feature (416)..(416): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccagtatataatagaaagttaagagtgatggcagccacaccgaaggggacggatccccgatcgcttcagtggctccagttcgtggggctgaccgctacctccaccatcctccaacctccagtctgacgatgagctagagtactcaacgttggagggaagagacgcccaaanactaaagttgaattcggggacctaaagggccggggttttggggtcgttccgggggacggaacggggacccaaaggccgttacggaccccgttccgtaaaggggtcccaaacggcccccgaaaggggtcccttaccgggaccccccccgttggggtaccctaaccgtttcccgttcccggtttaaccccccccgccctttaccccggtccggaccctttaaaccggggtaactaacccgg

SEQ ID NO: 347762 - DNA, 542 bp, Homo sapiens
  misc_feature: GZ8MTXP02JGOTX.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaaggggacggatccccgatcgcttcatgggctccagttctggggctgaccgctacctccaccatcctccaacctccagtctgacgatgagctgagtatcactgtggagagacgccacacaattgattcggaccaaagggacgggtttggggtcggttcggggacggacggggaccaaggcgtagaccgtcgtaaggtcacgcccaaggcctcgccccctggtccactctcgtcccgcctcgtcgctacgagtacg

SEQ ID NO: 347763 - DNA, 529 bp, Homo sapiens
  misc_feature: GZ8MTXP02FTDCD.15.86.H09.1.454.CMB.2.raw
  modified_base (405)..(405): a, c, t, g, unknown or other
  misc_feature (405)..(405): n is a, c, g, or t
  modified_base (514)..(514): a, c, t, g, unknown or other
  misc_feature (514)..(514): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaaggggacggatccccgatcgcttcatgggctccagttcgtggggctgaccgctacctccaccatctaccacctccagtctgacgatgagctgagtatcactgtaggagagagccanacaattgatggaccaaggacggttgggtgttcgggcggagggaccaagcgtgaccgtcgtaggtcacggcccaaggcctcgcccttcgcactctcgtccccaccctccncgctacgtacgtacg

SEQ ID NO: 347764 - DNA, 535 bp, Homo sapiens
  misc_feature: GZ8MTXP02GHS3D.15.86.H09.1.454.CMB.2.raw
  modified_base (383)..(383): a, c, t, g, unknown or other
  misc_feature (383)..(383): n is a, c, g, or t
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtccccccagtatataatagaaagttaagagtgatggcagccacaccaaggggacggatccccgatcgcttcatgggctccagttctggggctgaccgctacctccaccatctccaacctccagtctgacatgaggctgagtancactgtggagagagccacacaatgatggacaagacggttgggngttcgggnggagggaccaaggcgtcgaccgtcgtaggtcacgcccgaaaggctcggcccccctggccaccttcctcgttcccccgccctccgccgtcctacgtacgacg

SEQ ID NO: 347765 - DNA, 590 bp, Homo sapiens
  misc_feature: GZ8MTXP02GJE8A.15.86.H09.1.454.CMB.2.raw
  modified_base (408)..(408): a, c, t, g, unknown or other
  misc_feature (408)..(408): n is a, c, g, or t
  modified_base (464)..(464): a, c, t, g, unknown or other
  misc_feature (464)..(464): n is a, c, g, or t
tcagtctacgtagccacgaccggtgctcgatttagtgctatagacttgggtttgggggaagaggaagactgacggtcccccaggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaagggctggagtgggttggacgtttcaaaagtaaaatgatggtgagaaatagactacggtgcaccgtgaaaggagattcaccatctcaagagaataattacaaaaacgcggtagtatttgacaaaatgaaacagcctagaaaccgngacacagccgtactattactgtaccacagattcggaagtgcatcgaacgtaaaggngactatgtcttttgattatcgtggggacccagggacaagtggtacgtcgtctcgttcacgccctaccaccgaacgggcccatccgggtcccttcccccgtggcccacccctcctaccgaacgaccg

SEQ ID NO: 347766 - DNA, 578 bp, Homo sapiens
  misc_feature: GZ8MTXP02HMXQX.15.86.H09.1.454.CMB.2.raw
  modified_base (386)..(386): a, c, t, g, unknown or other
  misc_feature (386)..(386): n is a, c, g, or t
  modified_base (408)..(408): a, c, t, g, unknown or other
  misc_feature (408)..(408): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacacgaaggggacggatcccgatcgcttcagtggctccagttcgtggggctcgaccgctacctccaccatcctaccaacctccagtctgacgatgaggctgagtancagtggaggagagacgcccaanactaaagttcgaatcggggaccctaaagggtccggggttttggggtcgttacggggacggggaagggacccaaggccgttacggacccgttctaagggccacgccccgaaggcctcggccccctggtccaccgttcgtcgttccccgcccttcgcgactacgttagaccg

SEQ ID NO: 347767 - DNA, 525 bp, Homo sapiens
  misc_feature: GZ8MTXP02HKS9L.15.86.H09.1.454.CMB.2.raw
  modified_base (390)..(390): a, c, t, g, unknown or other
  misc_feature (390)..(390): n is a, c, g, or t
  modified_base (403)..(403): a, c, t, g, unknown or other
  misc_feature (403)..(403): n is a, c, g, or t
  modified_base (434)..(434): a, c, t, g, unknown or other
  misc_feature (434)..(434): n is a, c, g, or t
  modified_base (523)..(523): a, c, t, g, unknown or other
  misc_feature (523)..(523): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacaccgaaggggacggatccccgatcgcttcatgggctccagttctggggctgaccgctacctccaccatctccaacctccagtctgacatgaggctgagtatcactgnggagagacgccanacaattgatggaccaaaggtcgggtttgggngttcgggcggagggaccaagctggaccgtcaggcagcccaaggcctcgcccctggcacgtctcgttccccgctccgacgctagggtacncg

SEQ ID NO: 347768 - DNA, 525 bp, Homo sapiens
  misc_feature: GZ8MTXP02GWE47.15.86.H09.1.454.CMB.2.raw
  modified_base (352)..(352): a, c, t, g, unknown or other
  misc_feature (352)..(352): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (508)..(508): a, c, t, g, unknown or other
  misc_feature (508)..(508): n is a, c, g, or t
  modified_base (513)..(513): a, c, t, g, unknown or other
  misc_feature (513)..(513): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccaggaagtcccccagtatataatgaaagttaagagtgatggcagccacaccgaaggggacggatccccgatcgcttcatgggctccagttctggggctgaccgctacctccaccatccnccaacctccagtctgacgatgagctgatancatgngganaganccanacaattgaatggaccaaggtacgggttgggtgttcgggcggaagggccaaggctagaccgtcgtaggcacgcccaaggcctcgccccctggccacgtctcggtcccccncctcncgctacgacgcg

SEQ ID NO: 347769 - DNA, 535 bp, Homo sapiens
  misc_feature: GZ8MTXP02ISY1Y.15.86.H09.1.454.CMB.2.raw
  modified_base (392)..(392): a, c, t, g, unknown or other
  misc_feature (392)..(392): n is a, c, g, or t
  modified_base (400)..(400): a, c, t, g, unknown or other
  misc_feature (400)..(400): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaaggggacggatccccgatcgcttcatgggctccagttctggggctgaccgctacctccaccatctccaacctccagtctgacgatgagctgagtatcactgtgganagagccanacaattgatggccaaaggacggtttgggtgttcgggacgggagggaccaaggctaggaccgtcgtaggtcaggctacgaagggcctcgccccccgtggtccacgtcgtcgtccccacccgtcctcgctacgtacg

SEQ ID NO: 347770 - DNA, 549 bp, Homo sapiens
  misc_feature: GZ8MTXP02I1A28.15.86.H09.1.454.CMB.2.raw
  modified_base (389)..(389): a, c, t, g, unknown or other
  misc_feature (389)..(389): n is a, c, g, or t
  modified_base (393)..(393): a, c, t, g, unknown or other
  misc_feature (393)..(393): n is a, c, g, or t
  modified_base (401)..(401): a, c, t, g, unknown or other
  misc_feature (401)..(401): n is a, c, g, or t
  modified_base (546)..(546): a, c, t, g, unknown or other
  misc_feature (546)..(546): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacggatccccgatcgcttcatggctccagttcgtgggctgaccgctacctccaccatctccaacctccagtctgacgatgagctgagtatcactgngganagagccanacaattgatgggaccaaggacggtttggggagttcgggacgggaggggaccaaaggccgtaggacccgtacgagggtcacggtaccccgaagggcctcgccccctcggtaccactcttcgtccccaccctccgcgcctacggtanacg

SEQ ID NO: 347771 - DNA, 626 bp, Homo sapiens
  misc_feature: GZ8MTXP02IKL19.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccaggaagtcccccagtatataatagaaagttaagagtgatggcagccacaccgaaggggacggatccccgatcgctcagtggctccagttcgtgggctgaccgctacctccaccactcctaccaacctccagtctgacgatgaggctagagtatcacgtgtggagagagccaaacaactaaattgagtaggacccgtaaaggtacggggtttggggtcgggttaccggggacggggaacgggaaccgaaaggtccgtacggaacccgtccgtagggtaccaacggaccccgaaaggggcccttaccggccccccgttcggggtacccaaccgttcccgttccggtttccccccgcccccttacccgtccgtaccgttaaccggttacgaaccgg

SEQ ID NO: 347772 - DNA, 646 bp, Homo sapiens
  misc_feature: GZ8MTXP02I5SKX.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagacgaccgagggaacgtccccagtatataatagaaagttaagagtgatggcacgccacgaaccggaaggggaccggacgtcccgatcgtctcgagtcggctcgtaggttcgtgggctcgaccgctacctaccaccactccctaccaccctccacgtctacgacgtacgtgaggtcgtagacgttactcgtacgtgggtaggagaagacgacccaacacgtaaagttgaacgtacgggaacccgtaaaggggtcggggtttggggtcgggttaccgggggacgggaaccgggaaccgaacggtccgtacggaccccggttacgacggtacgaccggacccgaacggtcccgtccgtcccccgtacggtcccaccgttcccgtcccgttcccccgtccctccgcgtacctacggtacgcgg

SEQ ID NO: 347773 - DNA, 594 bp, Homo sapiens
  misc_feature: GZ8MTXP02HCE1A.15.86.H09.1.454.CMB.2.raw
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggagggctggagtgggtggacgttacaaaagtaaaatgatggtagagaaaatagactacggtgcacccgtgaaaggagattcaccatctacaagagataattacaaaaacgacggtagtatttgacaaatgaacagacctagaaccgaggacacagcctactattactagtaccacagattcggaaagtgacatcgaacgtaaaggaggactatgtacttttgattatcgtggggcccagggtacaagtggtacgtcgtctcgttcagcctaccaccgacgggccctacgtccggtccttcccccgtcggcccaccctcctacccaagaccg

SEQ ID NO: 347774 - DNA, 573 bp, Homo sapiens
  misc_feature: GZ8MTXP02GXMSB.15.86.H09.1.454.CMB.2.raw
  modified_base (407)..(407): a, c, t, g, unknown or other
  misc_feature (407)..(407): n is a, c, g, or t
  modified_base (439)..(439): a, c, t, g, unknown or other
  misc_feature (439)..(439): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaaggggacggatccccgatcgctcagtggctccagttcgtggggctcgaccgctacctccaccatctccaacctccagtctgacgatgagctgagtatcactggtggagagacgccaanacaattgagtaggccaaaggtcgggttggggngttcggggcggaagggaccgaaggcgtacggacccgtcgtaggtccacgaccccgaaaggtccctcggccccccgttgggtccctaccgtctaaccgttcccccgcccttcccgcgtacctacggtacgtaccg

SEQ ID NO: 347775 - DNA, 556 bp, Homo sapiens
  misc_feature: GZ8MTXP02IMYQD.15.86.H09.1.454.CMB.2.raw
  modified_base (347)..(347): a, c, t, g, unknown or other
  misc_feature (347)..(347): n is a, c, g, or t
  modified_base (403)..(403): a, c, t, g, unknown or other
  misc_feature (403)..(403): n is a, c, g, or t
  modified_base (464)..(464): a, c, t, g, unknown or other
  misc_feature (464)..(464): n is a, c, g, or t
  modified_base (518)..(518): a, c, t, g, unknown or other
  misc_feature (518)..(518): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaggggctggagtgggttggacgtttnaaagtaaaatgatggtgagaaatagactacggtgcaccgtgaaagagattcaccanctacaagagataatacaaaacgcgtatattgacaaatgaacagcctagaaaaccgagacanacgccgtatattaatcgtaccacagattacggaagtgcatacgaacgtaaaggngactaagtcgtactttagatacgtcgtacggggacccg

SEQ ID NO: 347776 - DNA, 556 bp, Homo sapiens
  misc_feature: GZ8MTXP02F00FV.15.86.H09.1.454.CMB.2.raw
  modified_base (404)..(404): a, c, t, g, unknown or other
  misc_feature (404)..(404): n is a, c, g, or t
  modified_base (550)..(550): a, c, t, g, unknown or other
  misc_feature (550)..(550): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaagggggacggatccccgatcgcttcatgggctccagttctggggctgaccgctacctccaccatctccaacctccagtctgacgatgagctgagtatcactgtggagagagccaanacaattcgatggaccaaaggcgggtttgggtcgttcggggacgggtaacgggaccaaggctacggaccgtcgtagggtcacggccccgaaggcctcgcccccgttcggccacttcgtcgttcccccgccctcctccggctaacggngtaccg

SEQ ID NO: 347777 - DNA, 552 bp, Homo sapiens
  misc_feature: GZ8MTXP02IXBHK.15.86.H09.1.454.CMB.2.raw
  modified_base (403)..(403): a, c, t, g, unknown or other
  misc_feature (403)..(403): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatggtatcaacagagacaggaacgtcccccagtatataatagaaagttaagagtgatggcagccacacgaaggggacggatccccgatcgcttcagtggctcgagttcgtggggctgaccgctacctccaccatctccaacctccatctgacgatgaggctgagtatcactgtaggagagagccanacaattgatggaccaagggtacgggttgggtcggttcggggacggaacgggaccaagtcgtaggacccgtcgtaggtcaacggcccgaaaggctcgccccctcggtcaccgttctccgttcccccaccgttccacggtctacgacgtcg

SEQ ID NO: 347778 - DNA, 549 bp, Homo sapiens
  misc_feature: GZ8MTXP02H79ID.15.86.H09.1.454.CMB.2.raw
  modified_base (408)..(408): a, c, t, g, unknown or other
  misc_feature (408)..(408): n is a, c, g, or t
  modified_base (442)..(442): a, c, t, g, unknown or other
  misc_feature (442)..(442): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccaggaacgtcccccagtatataatgaaagttaagagtgatggcagccacaccgaaggggacggatccccgatcgctcagtggctccagttcgtggggctgaccgctacctccaccatcctccaacctccagtctgacgactgagctgagtactcacgtgtggaagagacgcccaanacaattgaatgggaccaaagggacgggtttgggnggttcgggacgggaggaccaagcgtagacccgtcgtaggcacgacccgaaggcctccggccccctggcctactccgttcgtccccaccctctacgcctaacgtcacg

SEQ ID NO: 347779 - DNA, 565 bp, Homo sapiens
  misc_feature: GZ8MTXP02G7V8M.15.86.H09.1.454.CMB.2.raw
  modified_base (327)..(327): a, c, t, g, unknown or other
  misc_feature (327)..(327): n is a, c, g, or t
  modified_base (385)..(385): a, c, t, g, unknown or other
  misc_feature (385)..(385): n is a, c, g, or t
  modified_base (398)..(398): a, c, t, g, unknown or other
  misc_feature (398)..(398): n is a, c, g, or t
  modified_base (404)..(404): a, c, t, g, unknown or other
  misc_feature (404)..(404): n is a, c, g, or t
  modified_base (436)..(436): a, c, t, g, unknown or other
  misc_feature (436)..(436): n is a, c, g, or t
  modified_base (553)..(553): a, c, t, g, unknown or other
  misc_feature (553)..(553): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggatccccgatcgcttcagtggctcagttcnggggctgaccgctacctccaccatcctaccaacctccagtctgacgatgagctgagtncactgaggagagngccaanacaattgaatcggccaaaggcggggtttgggnggttcggggacggacggggaacccaaggcctacggacccgtccgttaaggggccaacggccccgaaagggcctccggcccccgtcggtaccaccgtctaaccgttccccacccttcncgctacgtagcg

SEQ ID NO: 347780 - DNA, 529 bp, Homo sapiens
  misc_feature: GZ8MTXP02I39X4.15.86.H09.1.454.CMB.2.raw
  modified_base (390)..(390): a, c, t, g, unknown or other
  misc_feature (390)..(390): n is a, c, g, or t
  modified_base (403)..(403): a, c, t, g, unknown or other
  misc_feature (403)..(403): n is a, c, g, or t
  modified_base (441)..(441): a, c, t, g, unknown or other
  misc_feature (441)..(441): n is a, c, g, or t
  modified_base (514)..(514): a, c, t, g, unknown or other
  misc_feature (514)..(514): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaaggggacggatccccgatcgcttcatgggctccagttctggggctgaccgctacctccaccatctccaacctccagtctgacgatgaggctgagtatcactgnggagagagccaanacaattgatggaccaaaggacgggttgggtgttcgggnggaagggaccaagcgtgaccgtctaggcagcccaaggcctgccccctggaccactctcgttccccgccctccncgccttacggacacg

SEQ ID NO: 347781 - DNA, 666 bp, Homo sapiens
  misc_feature: GZ8MTXP02G6Z24.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggatccccgatcgctcatggctccagttcgtggggctgaccgctacctccaccatctaccaacctccagtctgacgatcgagctagagtatcaactgaggagagacgccaacgaacaattgataggaccaaaggtacgggtttggggtcggttcggggacggggaacggggaaaccgaaaggtccgtacggaaccccggttacccggttaaacggggtaccgaaccggacccccggaaaaggggtccccgtacccggtccccccccgtttcgggggtaccccttaacccttcccgtttaaccggtttcccccccaaaccccggtttccccctaccggggtacccctttaaaccggttaacgtaaccccggg

SEQ ID NO: 347782 - DNA, 544 bp, Homo sapiens
  misc_feature: GZ8MTXP02JHDI6.15.86.H09.1.454.CMB.2.raw
  modified_base (405)..(405): a, c, t, g, unknown or other
  misc_feature (405)..(405): n is a, c, g, or t
  modified_base (529)..(529): a, c, t, g, unknown or other
  misc_feature (529)..(529): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaaggggacggatccccgatcgcttcatgggctccagttctggggctgaccgctacctcccaccatctccaacctccagtctgacgatgaggctgagtatcaatgtaggagagagccaanacaaattgatggaccaaaggtaccgggttgggtcgttcgggacggaaggggacccaaaggctggacccgtctagggcacgccccaaggcctcgccccctggtcacgtctcgttccccacctccncgcttacggataccg

SEQ ID NO: 347783 - DNA, 534 bp, Homo sapiens
  misc_feature: GZ8MTXP02IJJ13.15.86.H09.1.454.CMB.2.raw
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
  modified_base (519)..(519): a, c, t, g, unknown or other
  misc_feature (519)..(519): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtcccccagtatataatgaaagttagagtgatggcagccacaccgaaggggacggatccccgatcgcttcatgggctccagttcgtggggctgaccgctacctccaccatctccaacctccagtcctgactatgagctgatatcactgngganagagccaanacaattgatggccaaaggtacgggtttgggagttcggggacgggagggaccaagctggacccgtcgtaggcagaccccaggcctcgccccctggtccactctcgttccccaccttccncgcttaccgtagacg

SEQ ID NO: 347784 - DNA, 564 bp, Homo sapiens
  misc_feature: GZ8MTXP02GJ71W.15.86.H09.1.454.CMB.2.raw
  modified_base (410)..(410): a, c, t, g, unknown or other
  misc_feature (410)..(410): n is a, c, g, or t
  modified_base (561)..(561): a, c, t, g, unknown or other
  misc_feature (561)..(561): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggatccccgatcgcttcagtggctcagttcgtggggctgaccgctacctccaccatcctccaacctccagtctgacgatgaggctgagtatcacgtggtaggagagacgcccanaactaattgatgggaccaaaggtcgggtttggggtcgttcgggcgggaagggaccaaggctacggacccgtcgtagggtccacggcccgaaggcctccggcccccttcgggtccacgttcctcgttcccccacctccgtcgctaccggtanacg

SEQ ID NO: 347785 - DNA, 566 bp, Homo sapiens
  misc_feature: GZ8MTXP02JZKWY.15.86.H09.1.454.CMB.2.raw
  modified_base (300)..(300): a, c, t, g, unknown or other
  misc_feature (300)..(300): n is a, c, g, or t
  modified_base (356)..(356): a, c, t, g, unknown or other
  misc_feature (356)..(356): n is a, c, g, or t
  modified_base (409)..(409): a, c, t, g, unknown or other
  misc_feature (409)..(409): n is a, c, g, or t
  modified_base (561)..(561): a, c, t, g, unknown or other
  misc_feature (561)..(561): n is a, c, g, or t
  modified_base (564)..(566): a, c, t, g, unknown or other
  misc_feature (564)..(566): n is a, c, g, or t
tcagtctacgtagccacgaccggtgctcgatttagtgctatagacttgggtttgggggaagaggaagactgacggtcccttagagtctcctgtgtggcctctggattcactttcagtaatggctggatgagttgggtccgccaggctccagggaaggggctggagtgggttggacgtttcaaaagtaaaaatgatggtgagaaaatagactacggtgcacccgtgaaaggaagattcaccatctcaagagataattcaaaaaacgacggtgtatttgcaaatgaacagcctgaaaaccgnggacacagccgtctattactgtaccacagattcggaagtgcatcgacgtaaaaggnggctatgcttttgatactctggggccccaggggacaatggtcgtcgtctcttnagcctcaccaggcccatcgtcttccccctgccaccctcctccaagacgccacctcgtcgggggcacgacgccgggcccctggggcctcggcccgtggtccaagggacctacttccgctacgtacgactggacgcgggctggcgaaggcgcanagnnn

SEQ ID NO: 347786 - DNA, 593 bp, Homo sapiens
  misc_feature: GZ8MTXP02IOKRJ.15.86.H09.1.454.CMB.2.raw
  modified_base (444)..(444): a, c, t, g, unknown or other
  misc_feature (444)..(444): n is a, c, g, or t
  modified_base (575)..(575): a, c, t, g, unknown or other
  misc_feature (575)..(575): n is a, c, g, or t
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtgggttggacgtttacaaaagtaaaaatgatggtagaagaaaatagactaacggtgcacccgtgaaaggaagattcaccatctacaaagagataaattacaaaaaacgacggtagtatttgacaaaatgaaacagacctagaaaccgagaacacagccgtcattacngtaccacagattcggaagtgcatcgaacgtaaagagctaatgacttttgatatcgtggggacccaaggggacaaagtggtacgtgtctcttcacgccctaccaccaaacgggccccaatcggccttccccnggccaccctctccaaagc

SEQ ID NO: 347787 - DNA, 622 bp, Homo sapiens
  misc_feature: GZ8MTXP02H6B4T.15.86.H09.1.454.CMB.2.raw
  modified_base (351)..(351): a, c, t, g, unknown or other
  misc_feature (351)..(351): n is a, c, g, or t
  modified_base (407)..(407): a, c, t, g, unknown or other
  misc_feature (407)..(407): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaaggggacggatccccgatcgctcagtggctccagttcgtggggctgaccgctacctccaccatcnccaacctccacgtctgacgatgagtctgagtactcacgtgtggagagacgcccaanaacaaattgatcggacctaaaggtacggggtttggggtcggttcggggacggggaagggaccgaaggtccgtacggtaacccggtcgtacgggtaccacggacccccgtaaagggcccttacccggacccccccgtttcggggtaccctaaccgttccgttcccggtttccccccaacccgttcccgtccgtaccgtttaaccggtaacgaccgg

SEQ ID NO: 347788 - DNA, 655 bp, Homo sapiens
  misc_feature: GZ8MTXP02H4CLY.15.86.H09.1.454.CMB.2.raw
  modified_base (268)..(268): a, c, t, g, unknown or other
  misc_feature (268)..(268): n is a, c, g, or t
tcagtctacgtagccacgaccggtgctcgatttagtgctatagacttgggtttggggaagaggaagactgacggtcccccaggagttcgggctgagcgtggttttcgtgacgtgctatcttaaagtgtccagtgtgaagtgcaggtggtggagtctgggggagccttggtaaagcctggggggtcccttagagtctcctgtgtggcctctggattcacttttcagtaatggctggatgagttgggtccgccaggctccaggaaggggngtggaggtgggttggtacgtttactaaaagtaaaatagagtaggtagaagaaaataagaacgtacggtcgcgaccgtaggaaaggaaagatacaccatactacaagaagaataataacaaaacgaacggtagtattacgtacaaatagaacacgaccgtaacgaaccgaagaacaacgacgaccgtacttaacttactacgtaccacagtagtacggtaagtagactacgtacgaacgtaaaggaaggacgtagtagttgttttgtatatcgtcgggaccggacggacgaagtggtcgtcgttcttcttctacgacctaccaaccgacggaccgtaccgtccgttcccgttcccccgtccgtccctaccctaccctacccaacgacg

SEQ ID NO: 347789 - DNA, 588 bp, Homo sapiens
  misc_feature: GZ8MTXP02G4FGK.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaaggggacggactccccgatcgcttcagtgggctccgtagttcgtggggctcgaccgctacctcccaccactcctaccaaccctccacgtctagacgatgagctgagtactcacgtggtggagagacgccaacgactaattgatacgggccaaaggtcgggttgggtggttcggggacggacgggacccaaggccgtggacccgtccgaggtccgacgacccgaaggccctccggcccccgtcggttccaccgttctccgttcccccacccgtcctaccgtacctaccggtacgtaccgg

SEQ ID NO: 347790 - DNA, 550 bp, Homo sapiens
  misc_feature: GZ8MTXP02H0HBY.15.86.H09.1.454.CMB.2.raw
  modified_base (353)..(353): a, c, t, g, unknown or other
  misc_feature (353)..(353): n is a, c, g, or t
  modified_base (403)..(403): a, c, t, g, unknown or other
  misc_feature (403)..(403): n is a, c, g, or t
  modified_base (537)..(537): a, c, t, g, unknown or other
  misc_feature (537)..(537): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaaggggacggatccccgatcgcttcatgggctccagttcgtggggctgaccgctacctccaccatcnccaacctccagtctgacatgaggctgagtatcactgtggagagagccaanacaaattgaatgggacccaaaggacggggtttggggtgttcgggacgggaaggggacccaaaggctaggacccgtcctaaggtcagccccaaaggcctcgccccctggccactcctcgttccccgcccttaccnccgcacgtaagcg

SEQ ID NO: 347791 - DNA, 541 bp, Homo sapiens
  misc_feature: GZ8MTXP02F04VL.15.86.H09.1.454.CMB.2.raw
  modified_base (327)..(327): a, c, t, g, unknown or other
  misc_feature (327)..(327): n is a, c, g, or t
  modified_base (404)..(404): a, c, t, g, unknown or other
  misc_feature (404)..(404): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaaggggacggatccccgatcgcttcatgggctccagttcnggggctgaccgctacctccaccactctccaacctccagtctgacgatgagctgagtatcactgtggagagagccaanacaattgatgggaccaaaggtacggttgggtcgttcgggacggaggggaccaaggctaggacccgtcgtaggtcacgcccaaaggcctacgccccctggtccacgtctcgttccccaccctcctcgctacgtagacg

SEQ ID NO: 347792 - DNA, 530 bp, Homo sapiens
  misc_feature: GZ8MTXP02GWZKJ.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaaggggacggatccccgatcgcttcatgggctcagttctggggctgaccgctacctccaccatctccaacctccagtctgacgatgagctgagtatcactgtggagagagccacacaattgatggccaaggacgggttgggtgttcgggcggagggaccgaagctgaccgtcctaggtcacgcccaaggctacgccccctcggtccactcgtcgttccccaccctcctcgctacgacgtacg

SEQ ID NO: 347793 - DNA, 544 bp, Homo sapiens
  misc_feature: GZ8MTXP02JJLF3.15.86.H09.1.454.CMB.2.raw
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
  modified_base (529)..(529): a, c, t, g, unknown or other
  misc_feature (529)..(529): n is a, c, g, or t
  modified_base (540)..(540): a, c, t, g, unknown or other
  misc_feature (540)..(540): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggatccccgatcgcttcatggctccagttcgtggggctgaccgctacctccaccatcctaccaacctccagtctgacgatgagctgagtatcactgtggagagancccanacaagttgagtcggaccaagggtacggtttggggtgttcgggcgggacgggaccaagcgtacgacccgtcgtaggcacgcccgaaggcctccgccccgtcgtcactctcgtccccaccctccncgcctaacggntacg

SEQ ID NO: 347794 - DNA, 535 bp, Homo sapiens
  misc_feature: GZ8MTXP02F1R5R.15.86.H09.1.454.CMB.2.raw
  modified_base (405)..(405): a, c, t, g, unknown or other
  misc_feature (405)..(405): n is a, c, g, or t
  modified_base (433)..(433): a, c, t, g, unknown or other
  misc_feature (433)..(433): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaaggggacggatccccgatcgcttcatgggctccgagttctggggctgaccgctacctccaccatctccaacctccagtctgacgatgaggctgagtatcattgtggagagagccaanacaattgatggaccaaggacggttgggngttcgggcggaggggaccaaggctagacccgtcgtagggtcacgcccgaaaggctcgccccctggtccacgtctcgtccccacctcctcgctacgacgtacg

SEQ ID NO: 347795 - DNA, 539 bp, Homo sapiens
  misc_feature: GZ8MTXP02FXP1D.15.86.H09.1.454.CMB.2.raw
  modified_base (526)..(526): a, c, t, g, unknown or other
  misc_feature (526)..(526): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaaggggacggatccccgatcgcttcatgggctccagttctggggctgaccgctacctccaccatctccaacctccagtctgacgatgaggctgagtatcactgtggagagagccaacacaattgatgggaccaaaggtacgggttggggtgttcgggacggaacggggaccaaggctagaccgtctagggtcacgcccaaggcctcgccccctgttccactctcgttccccaccgtccncgctacgagtacg

SEQ ID NO: 347796 - DNA, 619 bp, Homo sapiens
  misc_feature: GZ8MTXP02HFZFV.15.86.H09.1.454.CMB.2.raw
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtggggttggacgtttacaaaagtaaaatgatggtagaagaaaatagactacggtgcacccgtagaaaggagattcaccatctacaagagaataattacaaaaacgacgtagtatttgacaaatgaacagacctagaaaccgaggaacacacgccgtactaattactagtaccacagattacggaaagtgacagtacgaaacgtaaaggaggactatgtcttttagattagtcgtacggggcccaggggacaagtggtcgtcgtctcttcgacgtccctaccgaccgaacgggcccagtccggtccctcccccgtggaccctacccctcccaccgaaacgccg

SEQ ID NO: 347797 - DNA, 641 bp, Homo sapiens
  misc_feature: GZ8MTXP02HYQ0X.15.86.H09.1.454.CMB.2.raw
  modified_base (415)..(415): a, c, t, g, unknown or other
  misc_feature (415)..(415): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccgaggaacgtcccccagtatataatagaaagttaagagtgatggcagccacgaccgaaggggacggatccccgatcgcttcagtgggctccgagttcgtggggctcgaccgctacctcccaccactcctaccaacctccacgtctgacgatgagcagagtatcacgttggaggaagagaacnccctaacaaactaagttgaaagttcgggaaccaaaggggttacggggtttggggtcggttacgggggacggggaacggggaacccaaggccgtacggacccgttaccgtaagggccacggacccccgaagggccctccggtcccccccgtagggtaaccctaccgttccttaacccggtttccccccaccccttccccgttccggacccttaacggttaacgccgg

SEQ ID NO: 347798 - DNA, 623 bp, Homo sapiens
  misc_feature: GZ8MTXP02HV7I8.15.86.H09.1.454.CMB.2.raw
  modified_base (451)..(451): a, c, t, g, unknown or other
  misc_feature (451)..(451): n is a, c, g, or t
  modified_base (595)..(595): a, c, t, g, unknown or other
  misc_feature (595)..(595): n is a, c, g, or t
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaagggctggagtgggttgacgtttacaaaagtaaaatgatggtagaagaaaatagactacggtgcacccgtagaaaggagatcaccatctacaagagaataaatacaaaaacgacggtagtatttgacaaatgaacagacctaagaaaccgaggaacacgacgccgtactaattactgtaacccanagacttcgggaaattgacatacggaaacgtaaaggaggcttaatgtcttttagattagtcgtggggacccagggacagtcggtcgtcgtctcttcacgccctaccgaccgaacgggcccctaagtcccggtccctttcccccgnggtcccaccccgttccacctaaagcccg

SEQ ID NO: 347799 - DNA, 516 bp, Homo sapiens
  misc_feature: GZ8MTXP02IOEUS.15.86.H09.1.454.CMB.2.raw
  modified_base (390)..(390): a, c, t, g, unknown or other
  misc_feature (390)..(390): n is a, c, g, or t
  modified_base (403)..(403): a, c, t, g, unknown or other
  misc_feature (403)..(403): n is a, c, g, or t
  modified_base (433)..(433): a, c, t, g, unknown or other
  misc_feature (433)..(433): n is a, c, g, or t
  modified_base (488)..(488): a, c, t, g, unknown or other
  misc_feature (488)..(488): n is a, c, g, or t
  modified_base (504)..(504): a, c, t, g, unknown or other
  misc_feature (504)..(504): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaaggggacggatccccgatcgcttcatggctccagttcgtggggctgaccgctacctcaccatctccaacctccagtctgacgatgaggctgagtatcactgnggagagagccaanacaattgatggaccaaggacgggtttgggngttcgggcggagggaccaagctgaccgtcaggcacgcccaaggctcgcccctgcnctctgtcccaccctcncgctacgtagcg

SEQ ID NO: 347800 - DNA, 617 bp, Homo sapiens
  misc_feature: GZ8MTXP02JSGKH.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaaggggacggatccccgatcgcttcatgggctcagttcgtggggctgaccgctacctccaccatctccaacctccagtctgacgatgaggctgagtatcacgttggtagggagagacgcccaacaacaaattgattacgggacccaaagggtaccggggtttggggtggttccgggggacgggaaggggacccaaaggccgtacggacccggtccgtaagggtccaacggcccccgaaagggccctaccggcccccccgttcgggtacccaccgttcccgtcggttaccccccacccgttcccgttaccggacccttacggtacgaaccg

SEQ ID NO: 347801 - DNA, 527 bp, Homo sapiens
  misc_feature: GZ8MTXP02FQARY.15.86.H09.1.454.CMB.2.raw
  modified_base (402)..(402): a, c, t, g, unknown or other
  misc_feature (402)..(402): n is a, c, g, or t
  modified_base (515)..(515): a, c, t, g, unknown or other
  misc_feature (515)..(515): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaaggggacggatccccgatcgcttcatgggctccagttctggggctgaccgctacctccaccatctccaacctccagtctgacgatgagctgagtatcactgtggagagagccanacaattgatggaccaaaggacgggttgggtcgttacgggcggaagggaccaaggctaggaccgtctaggtcacgccaaggctacgccccgtcgcactctcgtccccacctccncgctacgatacg

SEQ ID NO: 347802 - DNA, 590 bp, Homo sapiens
  misc_feature: GZ8MTXP02JRSQ7.15.86.H09.1.454.CMB.2.raw
tcagtctacgtagccacgaccggtgctcgatttagtgctatagacttgggtttggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggatccccgatcgcttcagtgggctccagttcgtggggctgaccgctacctccaccatcctaccaacctccagtctgacgatgaggctgagtatcactgtggagagagaccacacaatagagtaggaccgaaggacgggttggggttgggttcgggacggggagggaccgaacggacgtcgaccgtaccgtacggtacgacgacccgaacggtttttttttaccgccgtcccccgtcccggtccgacctcctccgttccccctaccccctcccctcccgtccgtaccgtacgtacg

SEQ ID NO: 347803 - DNA, 657 bp, Homo sapiens
  misc_feature: GZ8MTXP02GMRGU.15.86.H09.1.454.CMB.2.raw
  modified_base (384)..(384): a, c, t, g, unknown or other
  misc_feature (384)..(384): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaaggggacggatccccgatcgcttcatgggctccagttctggggctgaccgctacctccaccatctaccacctccagtctgacgatgaggctgagtanctacgtggtaggagagacgacccaacaactaagttagagtcggacccgtaaagggtaccggggtttggggttcggttaccgggggacggggaacggggaacccgtaaggccgttacgggacccccgttaccggtacgggtaccgaacggacccccgaaagggcccgttaccccggcccccccgtttacggggtaccctaaccgttcccgttccggtttcccccccggccccctttcccgtacccggtacccgtttaaccggtacgtaacccgg

SEQ ID NO: 347804 - DNA, 602 bp, Homo sapiens
  misc_feature: GZ8MTXP02H8O46.15.86.H09.1.454.CMB.2.raw
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctcagggagggctggagtggggttgacgtttcaaaagtaaaatgatggtgaagaaaatagactacggtgcacccgtgaaaggagattcaccatctacaagagataatacaaaaacgacggtagtattgacaaatgaacagacctagaaaccgaggaacaacgagccgtactaattactacgtaaccacagattacgggaagttgacatacggaacgtaaagggagacttatgtctttttagattatcgtcggggacccaggggacaagtggtacgtcgtctctcacgccctccaccaacggcccagtccggtcccttcccccgcggccacccctcctaccaacgacg

SEQ ID NO: 347805 - DNA, 588 bp, Homo sapiens
  misc_feature: GZ8MTXP02ITUSS.15.86.H09.1.454.CMB.2.raw
  modified_base (339)..(339): a, c, t, g, unknown or other
  misc_feature (339)..(339): n is a, c, g, or t
tcagtctacgtagccacgaccggtgctcgatttagtgctatagacttgggtttgggggacgttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccaggacgtcccccagtatataatgaaagttaagagtgatggcagccacgaccggaaggggaccggatccccgatcgcttcagtggctcagttcgtgggctgaccnctacctccaccatcctccaactccagtctgacgatgaggtctagactatcacgttgaggagacgaagcccaacaataattgaattacgggacctaaaggtacggggtttgggtacgtacggggacggaagggacccaagccgtagacccgtcgtaagtcgacggcccaaaggcctaccgcccccgttcgggtacccaccgttccgttaaccgtcccccgccttcccgtaccgccttaaccggtagcccg

SEQ ID NO: 347806 - DNA, 543 bp, Homo sapiens
  misc_feature: GZ8MTXP02GQWP7.15.86.H09.1.454.CMB.2.raw
  modified_base (272)..(272): a, c, t, g, unknown or other
  misc_feature (272)..(272): n is a, c, g, or t
  modified_base (405)..(405): a, c, t, g, unknown or other
  misc_feature (405)..(405): n is a, c, g, or t
  modified_base (530)..(530): a, c, t, g, unknown or other
  misc_feature (530)..(530): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaagttaaaaaagngtgatggcagccacaccgaaggggacggatccccgatcgcttcatgggctccagttctggggctgaccgctacctccaccatctccacctccagtctgacgatgagctgagtatcactggtggagagagccanacaattgagtggaccaaaggacgggtttggggtagttcggggacggaagggaccaaggctacggaccgtcgtaggtcacgcccgaagggcctcgcccccgtggtccactctcgtccccacctccncgctacgtacacg

SEQ ID NO: 347807 - DNA, 520 bp, Homo sapiens
  misc_feature: GZ8MTXP02I1NFM.15.86.H09.1.454.CMB.2.raw
  modified_base (506)..(506): a, c, t, g, unknown or other
  misc_feature (506)..(506): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaaggggacggatccccgatcgctcatgggctccagttctggggctgaccgctacctcaccatctccaacctccagtctgacgatgagctgagtatcactgtggagagagccaacacaattgattggccaaggacgggttgggtgttcgggcggagggaccaagctgaccgtctaggcagcccaaggcctagccccctggccactctcgtccccacctccncgcctacgactacg

SEQ ID NO: 347808 - DNA, 602 bp, Homo sapiens
  misc_feature: GZ8MTXP02HUAVC.15.86.H09.1.454.CMB.2.raw
  modified_base (413)..(413): a, c, t, g, unknown or other
  misc_feature (413)..(413): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacagggaacgtcccccagtatataatagaaagttaagagtgatggcagccacaccgaaggggacggactccccgatcgctcagtggctcgagttcgtgggctgaccgctacctccaccactcctaccaacctccagtctgacgatgaggctagagtatcagttggaggagagacgcccaanaactaattgatacggaccaaagggtcggggtttggggcgttacggggacgggaagggacccaaggtccgtacggacccgttcgtaaggcaacggaccccgaaagggccctaccggccccccttcgggtacctaaccgttcgtcccggtttcccccccgcccgttccgtacgtaccgttacggtacgacg

SEQ ID NO: 347809 - DNA, 527 bp, Homo sapiens
  misc_feature: GZ8MTXP02F5EKK.15.86.H09.1.454.CMB.2.raw
  modified_base (403)..(403): a, c, t, g, unknown or other
  misc_feature (403)..(403): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaaggggacggatccccgatcgcttcatgggctccagttctggggctgaccgctacctccaccatctccaacctccagtctgacgatgaggctgagtatcactgtggagagagccaanacaaattgatggccaaaggacgggtttgggtgttcggggcggaggggaccaagctggaccgtctaggcagcccaaggcctgccccctggtccactctcgttccccgcctccacgctacgtgacg

SEQ ID NO: 347810 - DNA, 617 bp, Homo sapiens
  misc_feature: GZ8MTXP02H4UAC.15.86.H09.1.454.CMB.2.raw
  modified_base (400)..(400): a, c, t, g, unknown or other
  misc_feature (400)..(400): n is a, c, g, or t
  modified_base (414)..(414): a, c, t, g, unknown or other
  misc_feature (414)..(414): n is a, c, g, or t
  modified_base (460)..(460): a, c, t, g, unknown or other
  misc_feature (460)..(460): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaaggggacggatccccgatcgcttcagtgggctccgagttcgtggggctcgaccgctacctccaccactcctacccaacctccagtctagacgatgaggctgagtatcattggnggagagacgccaanactaattgaatcgggaccaaggtacggggttgggtacgttcggggngggaacgggacccaagggccgtacggaacccggttcgaacgggtcacggaccccaaaggggtccctccgggcccccccttaggggtacctaccgttccgtttcccggttaccccccaaccccgttcccgttacggacccttaacggttacggaaccg

SEQ ID NO: 347811 - DNA, 581 bp, Homo sapiens
  misc_feature: GZ8MTXP02HQBHY.15.86.H09.1.454.CMB.2.raw
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
tcagtctacgtagccacgaccggtgctcgatttagtgctatagacttgggtttggggggacgttccctggtctcccttctacctactgcccttcattttctccacaggtctctgtgctctgcctgtgctgactcagccccgtctgcatctgcctttgctgggagcctcgatcaagctcacctgcaccctaagtagtgagcatcgaacctacaccatcgaatggtatcaacagagaccaggaagtcccccagtatataatagaaagttaagagtgatggcagccacaccgaaggggacggactcccgatcgctcgagtgggctccagttcgtggggctgaccgctacctccaccatctaccacctccagtcctgacgatcgagcnagtatcaatgnggaanagacnccctaaanaataatgataggacgtaaggtacgggttggtggtacgggacggaacggaaccgaagtccgtacgaccgtacgtaaggcacggacccgtaaggcctccgtcccccgtcggtcctacgttcccgtaacccggttcccccgccctaccctccgtaccgttaaccgacgtcg

SEQ ID NO: 347812 - DNA, 672 bp, Homo sapiens
  misc_feature: GZ8MTXP02G369E.15.86.H09.1.454.CMB.2.raw
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgaggggaaggggctggaggtggggttggacgtttacaaaagtaaaatgatggtagaagaaatagactacggtgcacccgtagaaaggaagattcaccatctacaagagataatacaaaacgacggtgtatttagacaaatgaacagaccgtaagaaaccggaggaacaacgacgtccgtacttaacttaccgtacgtacccaacagtaacgtttacgggaaagtgacgaactacggaaacggtaaagggaggtacttagtgtctttttagattacgtacggtcggggacccgagggtaactaaggttcggtacgtcgtcttccttcgacgtccctacccgaaccggaaccggtccctacgttcccggtccctttcccccgcggcccctacccctcccgtaccaacgacccg

SEQ ID NO: 347813 - DNA, 523 bp, Homo sapiens
  misc_feature: GZ8MTXP02JHAPM.15.86.H09.1.454.CMB.2.raw
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
  modified_base (432)..(432): a, c, t, g, unknown or other
  misc_feature (432)..(432): n is a, c, g, or t
  modified_base (509)..(509): a, c, t, g, unknown or other
  misc_feature (509)..(509): n is a, c, g, or t
tcagtctacgtagccacgaccggtgctcgatttagtgctatagacttgggtttggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaaggggacggatccccgatcgcttcatgggctccgagttcgtggggctgaccgctacctccaccatctccaacctccagtctgacgatgagctgagtatcatgngganagagccaanacaattgatggaccaaggacgggttgggngttcgggcgagggaccaaggctgaccgtctaggcagcccaggcctgccccctggcacgtctcgttccccaccgtccncgtctacgtagacg

SEQ ID NO: 347814 - DNA, 562 bp, Homo sapiens
  misc_feature: GZ8MTXP02HA4ZH.15.86.H09.1.454.CMB.2.raw
  modified_base (404)..(404): a, c, t, g, unknown or other
  misc_feature (404)..(404): n is a, c, g, or t
  modified_base (558)..(558): a, c, t, g, unknown or other
  misc_feature (558)..(558): n is a, c, g, or t
tcagtctacgtagccacgaccggtgctcgatttagtgctatagacttgggtttggggggacttccctggtctccttctacctactgcccttcattttctccacaggtctctttgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaaggggacggatccccgatcgctcatggctcagttcgtggggctgaccgctacctcacccatcctccaacctccagtctgacgatgaggctgagtatcagtggtgagagagaccaanactaaattgagtggaccaaaggtacgggttgggtggttacggcggggaagggaccaaggctaggaacccgtcgtagggtcacggcccaaagggtcctccgccccccttgggtccactcctcgttcccccacctccgtacgtctacgtacgtacncggg

SEQ ID NO: 347815 - DNA, 612 bp, Homo sapiens
  misc_feature: GZ8MTXP02HA14E.15.86.H09.1.454.CMB.2.raw
  modified_base (433)..(433): a, c, t, g, unknown or other
  misc_feature (433)..(433): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatgagttggtccgccaggctccgaggggaaggggctgggaggtgggtaggacgtttacgaaaaagtaaaatagagtaggtagaagaaaatagaactacggtgaccaccgtagaaaggaagatacacatctacaaaganaataatacaaaaacgtggtattattagactaaaatgaaacagaccgtaaagaaaacccgaggacccagacgaccctattaattacctagtacccaagaagtacgttacggaaagtgaccagtaccgaacggtaaaagggcgactaagtgttacgtttagatacgtcggtacgggacccg

SEQ ID NO: 347816 - DNA, 584 bp, Homo sapiens
  misc_feature: GZ8MTXP02I2C2A.15.86.H09.1.454.CMB.2.raw
  modified_base (409)..(409): a, c, t, g, unknown or other
  misc_feature (409)..(409): n is a, c, g, or t
  modified_base (567)..(567): a, c, t, g, unknown or other
  misc_feature (567)..(567): n is a, c, g, or t
tcagtctacgtagccacgaccggtgctcgatttagtgctatagacttgggtttggggaagaggaagactgacggtccccaggagttcgggctgagctgggtttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtggggttggacgtttcaaaagtaaaatgatggtgagaaaatagactacggtgcacccgtgaaaggagattcaccatctcaagagataaattacaaaaacgcggtagtatttgacaaaatgaaacagcctagaaaccgnggacacagccgtctattactgtaccacagattcggaaagtgcatcgaacgtaaaggagctatgctttttgattatcgtcgggggaccctaggggacaagtgggtcgtcgtctcttcagccctaccaccgaacgggccccagtccggtccttcccccgngcccaccctccacacgc

SEQ ID NO: 347817 - DNA, 573 bp, Homo sapiens
  misc_feature: GZ8MTXP02JJIFA.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaagggggacggatccccgatcgcttcatgggctccagttctggggctgaccgctacctccaccatctccaacctccagtcctgacgatgaggctgagtatcactgtggagagagccacacaattgatcgggacccaaagggtacgggtttggggtgtttccggggacgggaggggacccaaagggcttggacccgtcctagggtccacggccccgaaagggcctcggcccccctcgggtccaccttcgtcgttcccccaccctccgtcgaccttacggtagtaccg

SEQ ID NO: 347818 - DNA, 579 bp, Homo sapiens
  misc_feature: GZ8MTXP02I7CZQ.15.86.H09.1.454.CMB.2.raw
  modified_base (404)..(404): a, c, t, g, unknown or other
  misc_feature (404)..(404): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaaggggacggatccccgatcgcttcatgggctccagttctggggctgaccgctacctccaccatctccactccagtctgacgatgagctgagtatcactgtggagagagccctaaanataatgagtggacaagggtcgggttgggtcggtcggggacgggaacggaccaggcgtacggaccgtacgtaggcacggacccgaggtccctcccggcccccgttcggtaccctaccgttccgttccccgttaccccccacccgttcccgtaccggaccgttaacggtacgtaccg

SEQ ID NO: 347819 - DNA, 533 bp, Homo sapiens
  misc_feature: GZ8MTXP02JZXTL.15.86.H09.1.454.CMB.2.raw
  modified_base (370)..(370): a, c, t, g, unknown or other
  misc_feature (370)..(370): n is a, c, g, or t
  modified_base (393)..(393): a, c, t, g, unknown or other
  misc_feature (393)..(393): n is a, c, g, or t
  modified_base (405)..(405): a, c, t, g, unknown or other
  misc_feature (405)..(405): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacggatccccgatcgcttcatgggctccagttctggggctgaccgctacctccaccatctcccaacctccagtcngacgatgaggctgagtatcatgnggagagagccanacaaattgaatgggaccaaggacgggttggggtgttcgggcggagggacccaaggcgtgaccgtccgtaggcacgcccaaggctccgcccctcggtcacctctcgttccccacctctcgctacgtagc

SEQ ID NO: 347820 - DNA, 607 bp, Homo sapiens
  misc_feature: GZ8MTXP02H9Q9C.15.86.H09.1.454.CMB.2.raw
  modified_base (443)..(443): a, c, t, g, unknown or other
  misc_feature (443)..(443): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatacaacagaagaccgacgggaacgtcccccagtataataatagtaaagtagagtgatggacacgaccacgaaccggaaggggacggacgtccccgatcgtctcagtcggtctccgtaggttcgtgggctcgaccgtcctacctcccacactcctaccacctccagtccacgacgagtagagtcgtagtacgtctacgacggttggaggagaagacgaccaanacgtaattgagttcggaccgtaaaggtcggggtttgggcgggtacggggacgggaggacccaaggtcgtcggtaacccgtgtacggccacggacccgtaggcctacccggcccctggacctcgtcctcccgttccccgccctcgtacgccttaacggtcgacgg

SEQ ID NO: 347821 - DNA, 557 bp, Homo sapiens
  misc_feature: GZ8MTXP02JDJK3.15.86.H09.1.454.CMB.2.raw
  modified_base (330)..(330): a, c, t, g, unknown or other
  misc_feature (330)..(330): n is a, c, g, or t
  modified_base (409)..(409): a, c, t, g, unknown or other
  misc_feature (409)..(409): n is a, c, g, or t
  modified_base (443)..(443): a, c, t, g, unknown or other
  misc_feature (443)..(443): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacaccgaaggggacggatccccgatcgcttcatgggctccagttcnggggctgaccgctacctccaccatcctaccacctccacgtctgacgatgaggctgagtatcacgtgtggagagagccanacattgagtcgggaccaagggacgggtttggggngttcggggacggaaggggaccaaggcgtgacccgtcgtaggtccacgcccgaaggcctcgccccctcgggccaccgttcctcgtcccccacccttccgccgactacgtacgacg

SEQ ID NO: 347822 - DNA, 606 bp, Homo sapiens
  misc_feature: GZ8MTXP02FHQ7J.15.86.H09.1.454.CMB.2.raw
  modified_base (369)..(369): a, c, t, g, unknown or other
  misc_feature (369)..(369): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaagggggacggatccccgatcgcttcatgggctccagttcgtggggctgaccgctacctccaccatctccaacctccagtcngacgatgagctgagtatcactgtggagaagacgcccaacaactaattagagtacggaccaaaggtacggggtttggggtcgtttacgggggacgggaacggggacccaaaggccgttacggaacccgttccgtaaggggtccaacggccccgaaagggcctcggccccccgtcgggtccaccgttctaaccgtttcccccaaccccttcccgtccggtacctaaccggtacgtaccg

SEQ ID NO: 347823 - DNA, 607 bp, Homo sapiens
  misc_feature: GZ8MTXP02JN2IQ.15.86.H09.1.454.CMB.2.raw
tcagtctacgtagccacgaccggtgctcgatttagtgctatagacttgggtttgggggaagaggaagactgacggtcccccaggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcacccgtgaaaggagattcacatctcaagagataattcaaaaacgacggtgtatttcgacaaatgaacagcctagaaacccgaggaacacagccgtactattactgtaccacagattcggaaagtgacatcgaagtaaagaggctatgtcttttgattatcgtggggcccaggggactaagtcggtcgttcggtcttccttcacggtccctaccaaccgaacggggccccacgttccggtccttccccccgtggtcccaccccctcctacccgaaagtcccg

SEQ ID NO: 347824 - DNA, 587 bp, Homo sapiens
  misc_feature: GZ8MTXP02GTF9T.15.86.H09.1.454.CMB.2.raw
  modified_base (570)..(570): a, c, t, g, unknown or other
  misc_feature (570)..(570): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacaccgaaggggacggatccccgatcgcttcagtgggctcaagttcgtggggctgaccgctacctccaccatctaccaacctccagtctgacgatgaggctgagtatcactggtaggagagacgccaacactaaattgagttggaccgaaaggtccggggtttaggggtggttcggggacgggacgggacccaaggcgtacggacccgtccgtaggtccgaacgtcccgaaaggccttccgcccccttacgggtcccacgttcgtaaccgttcccccacccgttccnccgtactacgttgaccg

SEQ ID NO: 347825 - DNA, 545 bp, Homo sapiens
  misc_feature: GZ8MTXP02GRTQN.15.86.H09.1.454.CMB.2.raw
  modified_base (446)..(446): a, c, t, g, unknown or other
  misc_feature (446)..(446): n is a, c, g, or t
  modified_base (512)..(512): a, c, t, g, unknown or other
  misc_feature (512)..(512): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacacgaaggggacggatccccgatcgcttcagtggctcagttcgtggggctgaccgctacctccaccatccaccaacctccagtctagacgatgaggctagagtatcagtggtggagagacgccaacaacaattgaatcgggaccaaagggtcggggtttgggnggttccggggaggacgggaccaaggctcggaccgtctaggcacgacccaggcctcggcccctgacncgtcctcgtccccgcctcgcgactacgtacgcg

SEQ ID NO: 347826 - DNA, 628 bp, Homo sapiens
  misc_feature: GZ8MTXP02IZUFD.15.86.H09.1.454.CMB.2.raw
  modified_base (347)..(347): a, c, t, g, unknown or other
  misc_feature (347)..(347): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggtttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgccgaggctccgagggagggctggagtgggtggacgtttnaaaagtaaaatgatggtagagaaatagactacggtgaccaccgtgaaaggaagattcaccatctacaaagagataaattacgaaaaacgtacgtagttatttgacgtaaatagaaacagacctaaggaaaacccgaggaaccacgaacgcccgtactaattacgtacgtacccaacagtaacgtttaccggaagttcgacctaagtacggaaacggtaaaagggcggtacttaagttcggtactttttacggaatttacgtcggttacgggggaaccccgg

SEQ ID NO: 347827 - DNA, 621 bp, Homo sapiens
  misc_feature: GZ8MTXP02IC4O0.15.86.H09.1.454.CMB.2.raw
  modified_base (407)..(407): a, c, t, g, unknown or other
  misc_feature (407)..(407): n is a, c, g, or t
  modified_base (586)..(586): a, c, t, g, unknown or other
  misc_feature (586)..(586): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggactccccgatcgctcagtggctcagttcgtgggctgaccgctacctcccaccatctaccacctccagtctgacgatgagctgagtatcactgaggagagacgacccaanaacaattcggagttcgggacccgtaaaggggtcgggtttggggtcggttaccggggaccggggaagggaacccgaaggtccgtacggaccccgttacgtaaggggtcccaacggacccccgaaggtccctccggcccccccgtttcgggtccctacccgttccgtccggtttccccccnccccgttcccgtacgtcccgttacgtaacggccgg

SEQ ID NO: 347828 - DNA, 565 bp, Homo sapiens
  misc_feature: GZ8MTXP02H2794.15.86.H09.1.454.CMB.2.raw
  modified_base (299)..(299): a, c, t, g, unknown or other
  misc_feature (299)..(299): n is a, c, g, or t
  modified_base (326)..(326): a, c, t, g, unknown or other
  misc_feature (326)..(326): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtccccccagtatataatagaaagttaagagtgatggcagccacaccgaaggggacgganccccgatcgctcatggctccagttcgnggggctgaccgctacctccaccactcctaccaacctccagtctgacgagtgagctgagtactccagttggaggaagagacgcccaacacaaagtttgaatgggacctaaagggtacggggtttgggtggttcgggggacggaaggggaccctaaggctcgacccgttcgtagggcaggaccccagggcctccggccccctaggccactctcgtcccccaccttccagcctaacgtcgcg

SEQ ID NO: 347829 - DNA, 556 bp, Homo sapiens
  misc_feature: GZ8MTXP02G6UI0.15.86.H09.1.454.CMB.2.raw
  modified_base (298)..(298): a, c, t, g, unknown or other
  misc_feature (298)..(298): n is a, c, g, or t
  modified_base (387)..(387): a, c, t, g, unknown or other
  misc_feature (387)..(387): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacacgaaggggacgganccccgatcgcttcatgggctccagttcgtggggctgaccgctacctccaccatcctacccaacccccagtctgacgatgagctgagtancactgtaggagagacgccaacaacaaattgatcggaccaaagggtacgggttggggtgttcgggacggggaagggacccaagcgtacggacccgtcgtagggcacgacccgaaggcctcgccccctggtccactcctcgttcccaccctcctcgctacgtacgactcgg

SEQ ID NO: 347830 - DNA, 555 bp, Homo sapiens
  misc_feature: GZ8MTXP02FVI4G.15.86.H09.1.454.CMB.2.raw
  modified_base (403)..(403): a, c, t, g, unknown or other
  misc_feature (403)..(403): n is a, c, g, or t
  modified_base (540)..(540): a, c, t, g, unknown or other
  misc_feature (540)..(540): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaagggggacggatccccgatcgcttcatgggctccagttctggggctgaccgctacctccaccatctccaacctccagtctgacgatgagctgagtatcactgtggagagagccanacaattgatgggaccaaaggtacgggttggggtcgttcggggacgggtaacgggaccaaggcgtaggacccgtccgtaggtcaacggcccaaaggcctcggccccctggtaccacttcctcgttcccccaccctccncgactacggtacacg

SEQ ID NO: 347831 - DNA, 508 bp, Homo sapiens
  misc_feature: GZ8MTXP02I8EGE.15.86.H09.1.454.CMB.2.raw
  modified_base (383)..(383): a, c, t, g, unknown or other
  misc_feature (383)..(383): n is a, c, g, or t
  modified_base (396)..(396): a, c, t, g, unknown or other
  misc_feature (396)..(396): n is a, c, g, or t
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
  modified_base (495)..(495): a, c, t, g, unknown or other
  misc_feature (495)..(495): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatagaaagtaagagtgatggcagccacacgaaggggacggatcccgatcgctcatggctcagttcgtggggctgaccgctacctccaccatctaccaacctcagtctgacgatgagctgatatcatgnggagagagccaanacaatgatggacaaggacggttgggngtcgggnggagggacaagctgaccgtcaggcagccaaggctgccccctgtccactctcgttccccaccttccncgactacgtagcg

SEQ ID NO: 347832 - DNA, 544 bp, Homo sapiens
  misc_feature: GZ8MTXP02FQ4AT.15.86.H09.1.454.CMB.2.raw
  modified_base (328)..(328): a, c, t, g, unknown or other
  misc_feature (328)..(328): n is a, c, g, or t
  modified_base (401)..(401): a, c, t, g, unknown or other
  misc_feature (401)..(401): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacaccgaaggggacggatccccgatcgcttcatgggctccagttcnggggctgacgctacctcaccatctccaacctccagtctgacgatgagctgagtatcactgtggagagagccanacaattgatggccaaaggacgggttgggtgttcgggcggaacggggaccaaggcgacgaccgtcgtaggacacggacccaaggtcctccgccccctcggaccacgtcctcgtcccccaccctccgccgtacctacgacgtacg

SEQ ID NO: 347833 - DNA, 868 bp, Homo sapiens
  misc_feature: GZ8MTXP02GWNJX.15.86.H09.1.454.CMB.2.raw
tcagtctacgtagccacgaccggtgctcgatttagtgctatagacttgggtttggggggaagaggaagactgacggtccccccaggagttcgggctgagctgggtttccttgctgctatcttaaaaggtgtccagtgtgaagtgcaggtggtggagtcgtggggggagccttggtaaagccgtggggggtcccttagagtctcctgtgtggcctctggattcactttcagtaatggctggatggagttgggtccgccaggctcgaggggaggggctgggaggtgggttggacgtttaacaaaaagtaaaatgatggtagaaagaaaatagacgtacggtgaccaccggtagaaaggagattacacatctacaagagaataaattaacgaaaaacgtcggtagttaatttacgaactaaaagtacgaaacacgtaacccgtaaacggaaaacccgggaggaaaccgaaccgtaacgtaccccggttaacttaaactttaaaccgtaccgttaaaccccaaacgtaaaggtaacggtttaaccggggaaaagttacggaaccgtaaacggtaacccgggtaaaacgggttaaaaggggacgggtaacctttaaaggtttggttacctttttagaaacgttacggttaccgggttaccgggggaaccccgtaaagggggtaaacttaacgggttcgggttaccgttaccgtttccgttaccgttacccgaacccggttccccctaaacccgaaaccccgggtaaaacccggggtcccccttaacccgtttcccgggttaacccccctttccccccggtcccggtaccccctaaccccccgttaccctaccccggaaaacggtaacccccgg

SEQ ID NO: 347834 - DNA, 537 bp, Homo sapiens
  misc_feature: GZ8MTXP02IV399.15.86.H09.1.454.CMB.2.raw
  modified_base (325)..(325): a, c, t, g, unknown or other
  misc_feature (325)..(325): n is a, c, g, or t
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
  modified_base (423)..(423): a, c, t, g, unknown or other
  misc_feature (423)..(423): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacaggaacgtcccccagtatataatagaaagttaagagtgatggcagccacaccgaaggggacggatccccgatcgcttcatggctcagttcnggggctgaccgctacctccaccatcctaccaacctccagtctgacgatgaggctgagtatcatgagganagnccaananatgangacaggtggtgggngtcgggaggaggacagcgtacgaccgtacgtacgacacgccgaaggtcctaccgtcccctcgtacaccgttccgtccgtccccgcccgttaccgtccgaccgttacgtacgtcg

SEQ ID NO: 347835 - DNA, 533 bp, Homo sapiens
  misc_feature: GZ8MTXP02GAGVW.15.86.H09.1.454.CMB.2.raw
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (439)..(439): a, c, t, g, unknown or other
  misc_feature (439)..(439): n is a, c, g, or t
tcagtctacgtagccacgaccggtgctcgatttagtgctatagacttgggtttggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtccccccagtatataatagaaagttaagagtgatggcagccacaccgaaggggacggatccccgatcgcttcatgggctcagttctggggctgaccgctacctccaccatctccaacctcccagtctgacgatgagctgagtatcactggngganagagccacacaattgatgggaccaaggcgggttgggtgttcgggnggacgggaccaagctggaccgtcgtaggtcacgcccaaggcctcgccccctggtccacttcctcgttcccccacctcctcgctacgtacgtacg

SEQ ID NO: 347836 - DNA, 539 bp, Homo sapiens
  misc_feature: GZ8MTXP02FSGVS.15.86.H09.1.454.CMB.2.raw
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (402)..(402): a, c, t, g, unknown or other
  misc_feature (402)..(402): n is a, c, g, or t
  modified_base (499)..(499): a, c, t, g, unknown or other
  misc_feature (499)..(499): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatagaaagttaagagtgatggcagccacaccaaggggacggatccccgatcgcttcatgggctccagttctggggctgaccgctacctccaccatctccaacctccagtctgacgatgagctgagtatcactgngganagagccanacaatgatggaccaaggacgggttgggtagttcggggcggacgggaccaagcgtagaccgtctaggtcacgcccaaggctcgcccccgtcggtaccnccgttctccgttccccaccctcctcgtactacgtacgacg

SEQ ID NO: 347837 - DNA, 606 bp, Homo sapiens
  misc_feature: GZ8MTXP02HKFK8.15.86.H09.1.454.CMB.2.raw
  modified_base (418)..(418): a, c, t, g, unknown or other
  misc_feature (418)..(418): n is a, c, g, or t
  modified_base (451)..(451): a, c, t, g, unknown or other
  misc_feature (451)..(451): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtccttagagtctcctgtgtggcctctggattcactttcagtaatggctggatgagttggtccgccaggctccgagggaagggctggagtgggttgacgtttacaaaagtaaaaatgatggtagaagaaaatagactaaggtgcaccgtgaaaaggaagattcaccatctcaaagaanaataaataacgaaaaacgtagtatattacgaanaaatagaacagacaacgaaaacgaaacgaacgaacacgacgtactaacttaactacgtaaccacaacgtaagtacgtaagtacgacacgtaacgtaacgtaaaacggaaggacgtaagtacgtacgtttacgtagtacgtacgtacgggtaccgg

SEQ ID NO: 347838 - DNA, 596 bp, Homo sapiens
  misc_feature: GZ8MTXP02GYUI8.15.86.H09.1.454.CMB.2.raw
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtgggttggacgtttacaaaagtaaaatgatggtagagaaatagactacggtgcaccgtgaaaggagatcaccatctcaagagaataattacaaaaaacgtcggtagtatttgacaaaatgaaacagacctagaaaccgagacacagccgtactattactgtaccacagattcggaaagtgacatacgaacgtaaaggagactatgacttttgattagtcgtcgggacccagggacaagtcgggtctcgtctcgttcagccctacaccgaacggccctatccggtccttcccccgcggtccacccctcctaccaaagccg

SEQ ID NO: 347839 - DNA, 634 bp, Homo sapiens
  misc_feature: GZ8MTXP02IGBUH.15.86.H09.1.454.CMB.2.raw
  modified_base (430)..(430): a, c, t, g, unknown or other
  misc_feature (430)..(430): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccgagggaacgtcccccagtataataatagaaagttaagagtgatggcagccacgaaccggaaggggacggactccccgatcgcttacagtggctcgtagttcgtgggctcgaccgctacctccaccactctaccaacctccagtctagacgagtagagtcgtagagtatcgacgttggaggagaacgacgacccanaactaagttagagtacgggaccgtaaagggtacgggggttttggggtacgggttacggggacgggacgggaaccaaggtcgtacggacccggttacgagggtaccacggacccgaacgggccttacccggcccccttacggtccctacttcccggtaaccgtttcccccacccgttccgtaccgtaccgttaaacgtcgaccgg

SEQ ID NO: 347840 - DNA, 521 bp, Homo sapiens
  misc_feature: GZ8MTXP02JQ6SE.15.86.H09.1.454.CMB.2.raw
  modified_base (398)..(398): a, c, t, g, unknown or other
  misc_feature (398)..(398): n is a, c, g, or t
  modified_base (426)..(426): a, c, t, g, unknown or other
  misc_feature (426)..(426): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaaggggacggatccccgatcgcttcatggctccagttctggggctgaccgctacctccaccatctccaacctccagtctgacgatgagctgagtatcatgtggagagagccanacatgatggcaagcggttggtgtcgggngaggacagctgaccgtctaggtcacgcccaaggcctacggccccctcggtccaccgtcctcgttcccccgcccttcctcgaccttacgacgtacg

SEQ ID NO: 347841 - DNA, 568 bp, Homo sapiens
  misc_feature: GZ8MTXP02GNC0Q.15.86.H09.1.454.CMB.2.raw
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (389)..(389): a, c, t, g, unknown or other
  misc_feature (389)..(389): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaagggggacggatccccgatcgcttcatgggctccagttcgtggggctgaccgctacctcacaatcnccaaccnccagtctgacagtgaggctagagtancaacgtggtaggagagacgccaataacaaattgatggaccaaagggtacgggtttggggtagttcggggacggaacgggaaccaaggcctacggaacccgttccgtaaggccaacggccccgaaggcctcgcccccctggtccactctcgttccccgccctacctcgactacgactacg

SEQ ID NO: 347842 - DNA, 553 bp, Homo sapiens
  misc_feature: GZ8MTXP02H5HX0.15.86.H09.1.454.CMB.2.raw
  modified_base (405)..(405): a, c, t, g, unknown or other
  misc_feature (405)..(405): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacaccgaaggggacggatccccgatcgcttcatgggctccagttcgtggggctgaccgctacctccaccatctccaacctccagtctgacgatgaggctgagtatcactgtggagagagccanacaattcgagtggcccaaaggtacgggtttgggtgttcggggacggagggaccaaggctcgacccgtcgtaggtccacgcccaagggcctacgccccctcggtccacctctccgtttcccccgcccttcctacgccttacgacgtacg

SEQ ID NO: 347843 - DNA, 571 bp, Homo sapiens
  misc_feature: GZ8MTXP02JF8LG.15.86.H09.1.454.CMB.2.raw
  modified_base (528)..(528): a, c, t, g, unknown or other
  misc_feature (528)..(528): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggactccccgatcgcttcagtcggctccgagttcgtgggctcgaccgctacctccaccactccaccacctccagtctgacgatgaggctgagtatcacgtggaggagagagcccaacaactaagttgagtcggaccgtaaagggtcggggtttgggtcggttcggggacgggaggggaccaaggtcgtacggaccgtcgtaggcacggcccaaggcctcgcccccgtggccncctcgtccgttccccgccctaccgtcgaccttacggacgtacg

SEQ ID NO: 347844 - DNA, 650 bp, Homo sapiens
  misc_feature: GZ8MTXP02F8PA5.15.86.H09.1.454.CMB.2.raw
  modified_base (417)..(417): a, c, t, g, unknown or other
  misc_feature (417)..(417): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaccgaaggggacggactccccgatcgcttcagtgggctccagttcgtggggctgaccgctacctccaccactctaccaacctccagtctgacgagtgagctgatatcacgtggtaggagagacgccctaanaacattgatcggggaccctaaagggtcggggtttggggtcggttaccgggggacgggaacggggacccaaagggtccgttacggaccccggttaccgtaggggtccaacggcccccgaaaggggcccttacccgggacccccccgttcggggtaccctacccgttcccgttcccggtttaccccccaaccccgtttcccgtcccggtaccttaacccgggttagtaacccggg

SEQ ID NO: 347845 - DNA, 643 bp, Homo sapiens
  misc_feature: GZ8MTXP02IAR8Q.15.86.H09.1.454.CMB.2.raw
  modified_base (304)..(304): a, c, t, g, unknown or other
  misc_feature (304)..(304): n is a, c, g, or t
  modified_base (619)..(619): a, c, t, g, unknown or other
  misc_feature (619)..(619): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagacagggaacgtcccccagtatataatagaaagttaagagtgatggacagaccacgaaccgaaggggacggacnccccgatcgcttcagtggcctccgtagttcggtgggctcgaccgctacctcccaccactcctaccaacctccacgtctcgacgagtagacgtcgtagagtactacaacgtggtaggagacgacgacctaacaaactaagttggaatcggggaaccgtaaggggttacgggggtttgggggtcggtttaccgggggacgggaacggggacccaaaggtccgtacgggtacccggttcgtacgggtacccacggaccccggagggtcctccccggtcccccgttcggacccttccctccggttcccggttccccccncccgttccgcgtccgtcgtacgcg

SEQ ID NO: 347846 - DNA, 556 bp, Homo sapiens
  misc_feature: GZ8MTXP02HYA5O.15.86.H09.1.454.CMB.2.raw
  modified_base (281)..(281): a, c, t, g, unknown or other
  misc_feature (281)..(281): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccanaccaaggggacggatccccgatcgctcatggctccagttctggggctgaccgcactcaccatctcaacctccagtctgacgatgagctnagtaancatggagagagagacacaacaatagagtagacgaaggtacgggttagggtgggtcgggacgggacgggaacgaacgacgtacgaccgtaccgtacgtacgacgaccgacggacgtccgccccgtccgtccgtaccgtccgtccgtcccgtccccgtccctccgtaccgtacgtacgtacg

SEQ ID NO: 347847 - DNA, 533 bp, Homo sapiens
  misc_feature: GZ8MTXP02FLIYT.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaaggggacggatccccgatcgcttcatggctccagttctggggctgaccgctacctccaccatctccaacctccagtctgacgatgagctgagtatcactgtaggagagagccaacacaattgatgggccaaaggcggggttgggtagttcggggaggaggggacccaaggctaggaccgtcgtaggtcacgcccaaggcctcgccccctggtcacgtctcgtccccaccctctcgctacgtagacg

SEQ ID NO: 347848 - DNA, 554 bp, Homo sapiens
  misc_feature: GZ8MTXP02JHZJ6.15.86.H09.1.454.CMB.2.raw
  modified_base (444)..(444): a, c, t, g, unknown or other
  misc_feature (444)..(444): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagtaagagtgatggcagccacaccgaaggggacggatccccgatcgcttcatgggctccagttcgtggggctcgaccgctacctcccaccatcctaccacctccagtctgacgatgaggctgatatcactggtaggagagacgccagacaatgatggaccaaggtcgggttgggtgtacgggnggaacgggaccaagccgtagacccgttctagggcacgacccgaaggcctaccggccccctcgggactaccgtcctcgttcccccaccgttccacggacttacggactacg

SEQ ID NO: 347849 - DNA, 585 bp, Homo sapiens
  misc_feature: GZ8MTXP02GC6GM.15.86.H09.1.454.CMB.2.raw
  modified_base (421)..(421): a, c, t, g, unknown or other
  misc_feature (421)..(421): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaccgaaggggacggactccccgatcgcttcagtggctccgtagttcgtggggctcgaccgtctacctcccacactctaccaacctccagtcctagacgtagtgagctgagtatcacgtgtaggagagacgccaanactaattgagtcggaccaaagggtcgggttgggtacgttcggggacggacgggacaaggtctacggaccgtcgtaggtccgagtccccgaaggtcccgtaccgccccgtcggtaccctcttccgtccgttcccccgcctcccgtcgacgtaaccggtgtaccgg

SEQ ID NO: 347850 - DNA, 552 bp, Homo sapiens
  misc_feature: GZ8MTXP02GCN3A.15.86.H09.1.454.CMB.2.raw
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacaccgaaggggacggatccccgatcgcttcatgggctccgagtcgtggggctgaccgctacctcccaccatctaccacctccagtctgacgatgagctgagtatcactgtagganagacnccaanacaattgatggaccaaggtacgggttgggtgttcgggcgggaacgggaccaaggcgtaggacccgtctaggtcacggcccaaggcctccgccccctggtccacgttccgtcgttccccgcctcctcgactaccggtagaccg

SEQ ID NO: 347851 - DNA, 567 bp, Homo sapiens
  misc_feature: GZ8MTXP02IICTH.15.86.H09.1.454.CMB.2.raw
  modified_base (390)..(390): a, c, t, g, unknown or other
  misc_feature (390)..(390): n is a, c, g, or t
  modified_base (396)..(396): a, c, t, g, unknown or other
  misc_feature (396)..(396): n is a, c, g, or t
  modified_base (403)..(403): a, c, t, g, unknown or other
  misc_feature (403)..(403): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaatcccccagtatataatgaaagttaagagtagatggcagccacaccgaaggggacggatccccgatcgcttcatgggctccagttcgtgggctgaccgctacctcaccatctccaactccagtctgacgatgaggctagagtatcgactgngagagngcccaanacaatgagtcggaccaaggtcgggttgggtgtcgggacggacggacagcgtacgaccgtacgaggtacacggacccgaaggcctaccggcccccgttacggtacctacgttcccgttaaccgttcccccacccgttccgtaccgtaccgttaaacggtacgacg

SEQ ID NO: 347852 - DNA, 542 bp, Homo sapiens
  misc_feature: GZ8MTXP02ISYVS.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaaggggacggatccccgatcgcttcatgggctccagttctggggctgaccgctacctcccaccatcctccaacctccagtctgacgatgaggctgagtatcagtgtggagagagccacacaattgatggaccaaggacgggtttgggtggttcgggacgggagggaccgaagcgtcgaccgtctagggtcacgcccaagggcctacgccccctcggtccacctctcgttccccaccttccgcgcctacgtacgccg

SEQ ID NO: 347853 - DNA, 657 bp, Homo sapiens
  misc_feature: GZ8MTXP02GX3TX.15.86.H09.1.454.CMB.2.raw
  modified_base (352)..(352): a, c, t, g, unknown or other
  misc_feature (352)..(352): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacacgaaggggacggatccccgatcgctcatggctccagttcgtggggctgaccgctacctccaccatcnccaacctccagtctgacgatgagctgagtatcacgtggtagggagagacgcccaacaactaaattgaacttacgggaccctaaagggtcggggtttgggggtcgttaccgggggacgggaacgggtaaccaagggtcgtacggtaccccgttacgtaaacgggtcccaacgggtacccccgaaagggtcccctacccggtacccccccggttggggtacccctaaccgtttcccgtcccggtttacccccccaaccccgtttcccggtcccgtacccgtttaaacccgggtacgtaaaccccggg

SEQ ID NO: 347854 - DNA, 613 bp, Homo sapiens
  misc_feature: GZ8MTXP02JTJJE.15.86.H09.1.454.CMB.2.raw
  modified_base (555)..(555): a, c, t, g, unknown or other
  misc_feature (555)..(555): n is a, c, g, or t
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtggggttggacgtttacaaaagtaaaatgatggtgaagaaatagactacggtgcaccgtgaaaggaagattcaccatctcaagagaataattacaaaaacgcggtagtatttgacaaatgaaacagccctagaaacccgaggaacacgagccgtctaattacagtaaccacagtattacggaaagtgactagtacgaacggtaaaggacggctaatgtacttttgattacgtcgtcgggggacccaaggggtacaagtcgggttcgtcgtctcttacncgcctaccgacgacgccctacgtccgtccctcccgtacgccctaccctccacgacgcg

SEQ ID NO: 347855 - DNA, 618 bp, Homo sapiens
  misc_feature: GZ8MTXP02GQYSA.15.86.H09.1.454.CMB.2.raw
  modified_base (390)..(390): a, c, t, g, unknown or other
  misc_feature (390)..(390): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggatccccgatcgcttcatgggctccagttcgtggggctgaccgctacctcccaccactctaccaacctccagtctgacgatgagctgagtancagtgtggagagagcccaagactaattcgaattcgggacccaaagggtacggggtttggggtcggttacggggacgggaacggggaaccaagggtccgttacggaccccgttacgtaggggccaacggaccccgaaaggggtcccttccggcccccccgttcggtaccctaccgttccgtcccgtttcccccaccccgttcccgtccgacctttaacggtacgaccgg

SEQ ID NO: 347856 - DNA, 559 bp, Homo sapiens
  misc_feature: GZ8MTXP02I94SX.15.86.H09.1.454.CMB.2.raw
  modified_base (389)..(389): a, c, t, g, unknown or other
  misc_feature (389)..(389): n is a, c, g, or t
  modified_base (401)..(401): a, c, t, g, unknown or other
  misc_feature (401)..(401): n is a, c, g, or t
  modified_base (415)..(415): a, c, t, g, unknown or other
  misc_feature (415)..(415): n is a, c, g, or t
  modified_base (521)..(521): a, c, t, g, unknown or other
  misc_feature (521)..(521): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatacgaacctacaccatacgaatggtatcaacagaacgaccgagggaaccgtcccccagtataataatagaaagttaagagtgatggcagaccacgacggaaggggacggactcccgatcgctcagtcggctcgtagttcgtgggctcgaccgctacctccaccactcctacccacctccgatcgtgacgntagagctgatcnagtgaggagagacncctacatatgagtcggacgtaagggtcgggtttaggggtgtacgggacgggaggaccagtcgacggccgttacgaggcaacggcccaggccctccgcccgtcgtcnctccgtccgtacccctcctcgtcgaccgtacgacgtcg

SEQ ID NO: 347857 - DNA, 671 bp, Homo sapiens
  misc_feature: GZ8MTXP02JPQ7D.15.86.H09.1.454.CMB.2.raw
  modified_base (407)..(407): a, c, t, g, unknown or other
  misc_feature (407)..(407): n is a, c, g, or t
  modified_base (448)..(448): a, c, t, g, unknown or other
  misc_feature (448)..(448): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacaccgaggggacggatccccgatcgctcatggctccagttctggggctgaccgctacctccaccatctccaacctccagtctgacgagtgaggctgagtatcacgtgtggagagacgcccaanacaaagttgattaggccctaaaagggtcgggttttgggggngtttaccgggggacggtaacgggggaaccccaaagggtccgtacgggtaaccccggttcgttaaaacggggtcccaacgggaccccccgaaagggggtcccctacccgggtccccccccgtttcgggggtaaccctacccggttcccgtttccggggtttacccccccggccccctttaccccggtccggtaccccgtttaaaacgggggtcctaaacccggg

SEQ ID NO: 347858 - DNA, 659 bp, Homo sapiens
  misc_feature: GZ8MTXP02G4A9F.15.86.H09.1.454.CMB.2.raw
  modified_base (415)..(415): a, c, t, g, unknown or other
  misc_feature (415)..(415): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagacagggaactccccagtatataatagaaagttagagtgatggcagccacgaccggaaggggaccggactccccgatccgcttcagtggctcgtagttcgtgggtctgaccgctacctcccacactccacctaacctccaagtctagacgagtgaggctgagtactcgaacgtgaggagagtacnccaacataagttgacgtacgggacctaaggggtacgggtttggggtacgttaccgggggacgggtaacgggaacccgaaggtccgttacgggaacccgttacccggttaggtaccgaaccggacccgtaaacggggtccccgtacggaccccccgtttacggggtaccctacccgtttccgtaacccgggtttcccccccgtaccccgttaccggtacccgtaccggttaccggtacgtaccgg

SEQ ID NO: 347859 - DNA, 706 bp, Homo sapiens
  misc_feature: GZ8MTXP02FI64V.15.86.H09.1.454.CMB.2.raw
  modified_base (396)..(396): a, c, t, g, unknown or other
  misc_feature (396)..(396): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcacctaagtagtgagcatcgaacctacaccatcgaatggtatcaacagagaccagggaacgtccccccagtatataatagaaagttaagagtgatggcagccacaccgaaggggacggatccccgatcgcttcatgggctccagttcgtggggctcgaccgctacctccaccatcctccaacctcccagtctgacgatcgaggctaggattaacncagtggtaggagagacgaccaactaacgtaagttacggagtaccgggaaccgtaaaggggttacgggggtttacgggggttcggggttaccgggggacgggggaacggggtaacccgaaaggtcccgtacgggaccccggttaccggtaacgggtacccgaacccggtaccccggaaacgggtccccctaccccggtacccccccggttaccgggtaccctacccgttacccgttaaccccgttaccccccgttaccccccgttacccccgttaccccggtacccggttaacccggtaaccggtaaccgg

SEQ ID NO: 347860 - DNA, 585 bp, Homo sapiens
  misc_feature: GZ8MTXP02H94WN.15.86.H09.1.454.CMB.2.raw
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggagggctggagtgggttggacgtttcaaaagtaaaatgatggtgagaaaatagactacggtgcaccgtgaaagagatcaccatctcaagagataatacaaaaacgcggtgtatttgacaaatgaaacagacctagaaacccgaggaacacacgccgtacattactgtaccacagattacggaagtgcatcgaacgtaaagagctatgtcttttgattatcgtgggggcccaggggacaaagtggtcgtcgtctcgttcagccctccaaccaacgggcccctatccggtccttcccccgtggcctacccctccctacaacgcg

SEQ ID NO: 347861 - DNA, 526 bp, Homo sapiens
  misc_feature: GZ8MTXP02F4J5Y.15.86.H09.1.454.CMB.2.raw
  modified_base (392)..(392): a, c, t, g, unknown or other
  misc_feature (392)..(392): n is a, c, g, or t
  modified_base (400)..(400): a, c, t, g, unknown or other
  misc_feature (400)..(400): n is a, c, g, or t
  modified_base (430)..(430): a, c, t, g, unknown or other
  misc_feature (430)..(430): n is a, c, g, or t
  modified_base (499)..(499): a, c, t, g, unknown or other
  misc_feature (499)..(499): n is a, c, g, or t
  modified_base (514)..(514): a, c, t, g, unknown or other
  misc_feature (514)..(514): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaaggggacggatccccgatcgcttcatgggctccagttctggggctgaccgctacctccaccatctccaacctccagtctgacgatgagctgagtatcactgtgganagagccanacaattgatgggaccaaaggcgggttgggngttcgggcggagggaccaagctgaccgtcctaggtcacgccccaaggcctcgccccctggtccacgtcncgttccccacctccncgctacgagtac

SEQ ID NO: 347862 - DNA, 613 bp, Homo sapiens
  misc_feature: GZ8MTXP02H6VAM.15.86.H09.1.454.CMB.2.raw
  modified_base (378)..(378): a, c, t, g, unknown or other
  misc_feature (378)..(378): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccaggaagtcccccagtatataatgaaagttagagtgatggcagccacaccgaaggggacggatccccgatcgcttcatgggctccagttcgtggggctgaccgctacctccaccatcctaccaacctccagtctgacagtgagtcngatatcagtgaggagacgagcccaacgaacaattgaagtgggaacctaaagggtcgggtttgggggtcgttacggggaccggggaagggaacccaaagggtccgtaggaaccccggttcgtaacgggtaccacggacccccgtaaagggcccctccggccccccgttacgggccctaacctcccgttcggttccccccgtaacccctccttaccgacccgttacggtaacgccgg

SEQ ID NO: 347863 - DNA, 605 bp, Homo sapiens
  misc_feature: GZ8MTXP02IR10P.15.86.H09.1.454.CMB.2.raw
  modified_base (364)..(364): a, c, t, g, unknown or other
  misc_feature (364)..(364): n is a, c, g, or t
  modified_base (414)..(414): a, c, t, g, unknown or other
  misc_feature (414)..(414): n is a, c, g, or t
  modified_base (426)..(426): a, c, t, g, unknown or other
  misc_feature (426)..(426): n is a, c, g, or t
  modified_base (433)..(433): a, c, t, g, unknown or other
  misc_feature (433)..(433): n is a, c, g, or t
  modified_base (469)..(469): a, c, t, g, unknown or other
  misc_feature (469)..(469): n is a, c, g, or t
  modified_base (475)..(475): a, c, t, g, unknown or other
  misc_feature (475)..(475): n is a, c, g, or t
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggagggctggagtgggttggacgttacaaaagtaaaatgatggtagaagaaaatagactacggtgccacccgtagaaaggagattcaccatctacaaganataaattacaaaaacgcggtatattgacaaatgaacagcctagaaaccgngacacagccgtntattacncgtaccacagattcggaagtgcatcgaagtaaaggngactangtctttgattagtcgtcgggggcccaggggtacaagtggtcgtcgtcttctcacgccccgtacaccgaacgggccccacgttccggtccttccccccgtaggacccccacccgtccctaccgaaggtccg

SEQ ID NO: 347864 - DNA, 530 bp, Homo sapiens
  misc_feature: GZ8MTXP02IQAHE.15.86.H09.1.454.CMB.2.raw
  modified_base (402)..(402): a, c, t, g, unknown or other
  misc_feature (402)..(402): n is a, c, g, or t
  modified_base (514)..(514): a, c, t, g, unknown or other
  misc_feature (514)..(514): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggagtcccccagtatataatgaaagttaagagtgatggcagccacaccgaaggggacggatccccgatcgcttcatggctccagttctggggctgaccgctacctccaccatctccaacctccagtctgacgatgaggctgagtatcactgtggagagagccaanacaaatgatggaccaaaggacggtttggggtgttcgggacgggagggaccaaggctaggaccgtcaggtcacgccaaggctcgcccctcggcactctcgtccccgacctccncgacctacgacgtacg

SEQ ID NO: 347865 - DNA, 662 bp, Homo sapiens
  misc_feature: GZ8MTXP02JPQQT.15.86.H09.1.454.CMB.2.raw
  modified_base (385)..(385): a, c, t, g, unknown or other
  misc_feature (385)..(385): n is a, c, g, or t
  modified_base (417)..(417): a, c, t, g, unknown or other
  misc_feature (417)..(417): n is a, c, g, or t
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgaaggtggtggagtctgggggagccttggtaaagcctggggggtcccttagagtctcctgtgtggcctctggattcactttcagtaatggctggatgagttgggtccgccaggctccagggaagggctggagtgggttggacgtttacaaaagtaaaatgatggtagaagaaaatagactacggtgcaccgtagaaaggaagattcaccatctacaagagataaattacaaaaacgacggtntatttgacaaatgaacagacctagaaaaccgnggacaacacgccgtactagttactgtaaccacagtattacggaagtgacagtacgaaacggtaaaagggaggacttaagtgtacttttagagttaacgttcgggtacgggggacccgaggggaacctaaggttcggtaccgttcgtacttcgtttacacggtccctacccgaacccgtaacgggcccctacgtccggtccccttcccccggcggtaccctaccccttcccaccgaacgacgcccg

SEQ ID NO: 347866 - DNA, 601 bp, Homo sapiens
  misc_feature: GZ8MTXP02JG7E0.15.86.H09.1.454.CMB.2.raw
  modified_base (377)..(377): a, c, t, g, unknown or other
  misc_feature (377)..(377): n is a, c, g, or t
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggatccccgatcgcttcatgggctccgagttcgtggggctcgaccgctacctccaccatcctactacctccagtctgacgntgagctagagtatcacgtgtggagagacnccaacanaattgaattcgggaccaaaggggtacgggtttggggtcgttcgggggacggaagggggaccaaagggctacgggaacccgttccgagggtccaacggcccccgaaagggtccctaccggccccccgttgggtaccctacgttccctcgttcccccacccgttcctccgacctttaaccggactaccgg

SEQ ID NO: 347867 - DNA, 530 bp, Homo sapiens
  misc_feature: GZ8MTXP02G6M6M.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaccgaaggggacggatccccgatcgcttcatggctcagtctgggctgaccgctacctccaccatctccaacctccagtctgacgatgaggctagagtatcaacgtggtggagagacgcctacacaattgatggaccaaaggtcgggttagggtgttcgggcgggaggaccgaaggctacggaccgtcgtagcacgcccaaggctcgcccctgcacgtctcgtcccacctcacgctacgtagacg

SEQ ID NO: 347868 - DNA, 570 bp, Homo sapiens
  misc_feature: GZ8MTXP02GW92D.15.86.H09.1.454.CMB.2.raw
  modified_base (366)..(366): a, c, t, g, unknown or other
  misc_feature (366)..(366): n is a, c, g, or t
  modified_base (474)..(474): a, c, t, g, unknown or other
  misc_feature (474)..(474): n is a, c, g, or t
  modified_base (505)..(505): a, c, t, g, unknown or other
  misc_feature (505)..(505): n is a, c, g, or t
  modified_base (535)..(535): a, c, t, g, unknown or other
  misc_feature (535)..(535): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcctttagagtctcctgtgtggcctctggattcactttcagtaatggctggatgagttgggtccgccgaggctccgagggaaggggctggagtgggttggacgtttcaaaagtaaaatgatggtnagaaaatagactacggtgacacccgtgaaaggaagagttacaccatctcaaagagaataattacaaaaacgaggtagtattgacaaatagaacagcctagaaaaccgnggaacacgagacccgtatatactagtaccanagatcggaatgacagtcgacgtaaaggagntaagtgtacttttagatactcgtacgggggacccg

SEQ ID NO: 347869 - DNA, 575 bp, Homo sapiens
  misc_feature: GZ8MTXP02GF3SD.15.86.H09.1.454.CMB.2.raw
  modified_base (406)..(406): a, c, t, g, unknown or other
  misc_feature (406)..(406): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaaggggacggatccccgatcgcttcatgggctcagttcgtggggctcgaccgctacctccaccatctccaacctccagtctgacgatgagctgagtactcactgtaggagagacgccanactaattagatcggaccaaagggtcgggttggggtggttccggggacgggagggacccaaggccgtaggacccgtccgtaagggtccaacggccccgtaaaggccctccggcccccgttacggtccaccgttcctccgttccccacccgtcctccgctacgtacgaccg

SEQ ID NO: 347870 - DNA, 610 bp, Homo sapiens
  misc_feature: GZ8MTXP02JRDOE.15.86.H09.1.454.CMB.2.raw
  modified_base (434)..(434): a, c, t, g, unknown or other
  misc_feature (434)..(434): n is a, c, g, or t
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtggggttggacgtttcaaaagtaaaatgatggtgagaaatagactacggtgcacccgtgaaaggagatcaccatctcaagagataattacaaaaacgacggtagtatttagacaaatgaaacagacctagaaccgaggacacagccgtactattacngtaccacagattacggaagtgcatacgaacggtaaaggaggactagtgtactttagattatcgtggggaccctaggggacaagtcggtcgtcgtctcttcgacgccctccgaccgaacgggccccacgttccgggtcccttcccccgcggccccaccctccctaccgaacgacccg

SEQ ID NO: 347871 - DNA, 619 bp, Homo sapiens
  misc_feature: GZ8MTXP02F3IMW.15.86.H09.1.454.CMB.2.raw
  modified_base (486)..(486): a, c, t, g, unknown or other
  misc_feature (486)..(486): n is a, c, g, or t
  modified_base (500)..(500): a, c, t, g, unknown or other
  misc_feature (500)..(500): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgcgaggctccgaggggaaggggcgtggaggtggggttggacgtttacaaaaggttaaaatgagtggtagaagtaaaatagaactacggtgaccgacccgtagaaaggagattacaccatctacaaagagaataatacaaaagtacgtatattagacaaatgaacagaccagaaaaccgngaccacagaccgtntaattacacgtaccaacgtagtaacgttacggaaagttgaccgtaagtacggaaaacggtaaaaggcggtactaagttcgtacgttttagacgttacgtccgggtacggggaaccccgg

SEQ ID NO: 347872 - DNA, 561 bp, Homo sapiens
  misc_feature: GZ8MTXP02FSAB8.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatagaaagttaagagtgatggcagccacaccgaaggggacggatcccgatcgcttcagtggctccagttctggggctgaccgctacctccaccatctcccaacctccagtcctgacgatgagctgagtatcactggtaggacgagagcccaacacaattgatcgggaccaaaggcgggttgggtggttcggggacggacgggaccaaggctacggaccgtcgtaggccacggccccaaggtcctccgcccccgtaccggtcaccgttctccggttccccacccgtccctacgcttacgactacg

SEQ ID NO: 347873 - DNA, 575 bp, Homo sapiens
  misc_feature: GZ8MTXP02H7H12.15.86.H09.1.454.CMB.2.raw
  modified_base (387)..(387): a, c, t, g, unknown or other
  misc_feature (387)..(387): n is a, c, g, or t
  modified_base (401)..(401): a, c, t, g, unknown or other
  misc_feature (401)..(401): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccaggaacgtcccccagtatataatgaaagttaagagtgatggcagccacaccgaaggggacggatccccgatcgcttcatggctcagttcgtggggctgaccgctacctccaccatctccaacctccagtctgacgatgaggctgatatcatgnggagagacgccaanacaaattgatgggaccaaagggtacgggtttggggtaggttcggggacgggaaggggaacccaaggtcctaggacccgtcctaggggtccacggccccgaaagggcccttcggcccccccgttgggcctacctcttccgtcccccgcccttccgtccgaccttaacgtacgacg

SEQ ID NO: 347874 - DNA, 621 bp, Homo sapiens
  misc_feature: GZ8MTXP02G5DIG.15.86.H09.1.454.CMB.2.raw
  modified_base (306)..(306): a, c, t, g, unknown or other
  misc_feature (306)..(306): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatgtatacaacagagaccgaggaacgtccccagtatataatagaaagttaagagtgagtggcacgccacgaccggaaggggacggacnccccgatcgctcagtcggctcgtagttcgtggggctcgaccgctacctcccacctactcctacccaaccctccacgtctacgacgagtaggacggtcgtagtacgtatcgaacggttggtagggaagacgaacgcccaaacgtaactaaagttgaacgtacggaccgtaaaggggttcggggtttggggtcggttcggggacggaacggacaggtcgtacgccgttacgaggtccacggcccgagcccgtccgcccccgttggccaccgttcgtccgttcccccgcccgttacgccggtaccttacggtacgacg

SEQ ID NO: 347875 - DNA, 624 bp, Homo sapiens
  misc_feature: GZ8MTXP02F8YTH.15.86.H09.1.454.CMB.2.raw
  modified_base (351)..(351): a, c, t, g, unknown or other
  misc_feature (351)..(351): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaccggaaggggacggactccccgatcgcttcagtggctccgagttcgtggggctcgaccgctaccnccaccactcctaccaacctccagtctagacgagtgagctgagtatcacgtggtaggaagacgacgcccaacgaactaattagacgttacgggaccgtaaagggtacgggggtttgggggtacggttaccgggggacgggacgggaaccaaggtccgtacggacccgtcgtacgggccacggacccccgaagggccctaccggcccccgttacgccctaccttccgttaacccgttccccctaccctccgtccgacgttacccgtagtacccgg

SEQ ID NO: 347876 - DNA, 583 bp, Homo sapiens
  misc_feature: GZ8MTXP02IOZIV.15.86.H09.1.454.CMB.2.raw
  modified_base (411)..(411): a, c, t, g, unknown or other
  misc_feature (411)..(411): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacacgaaggggacggatccccgatcgcttcatgggctccagttcgtggggctcgaccgctacctccaccatcctccaacctccagtctgacgatgagctgagtatcaactggtaggagagacgcccaanaactaattgatcgggaccaaagggtacgggttgggtcgggttccggggacgggacgggaccaaggtccgtacgacccgtacgtaggtccaacgggccccgaaagggcctccggcccccgttcggtccaccgttcctcgttcccccacctccctcgtcctaacgtcgtaaccg

SEQ ID NO: 347877 - DNA, 629 bp, Homo sapiens
  misc_feature: GZ8MTXP02GSUJX.15.86.H09.1.454.CMB.2.raw
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
tcagtctacgtagccacgaccggtgctcgatttagtgctatagacttggggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggatccccgatcgcttcagtggctccagttcgtggggctgaccgctacctccaccatctccaaccgtccagtctgacgatgagctgatatcagtgngganagngaccanacaattgatgggaccaaaggtcgggttaggggtgttcggggacggaacgggaccctaaggcgtacggacccggttcgtaaacggggtccaacggacccccgaaagggtcccgttaccggccccccccgttaaggggtacccacccggtttccctcccggttttaccccccaacccccgtttccccgttccggaccccgttaacgggttacgtaaccccgggg

SEQ ID NO: 347878 - DNA, 676 bp, Homo sapiens
  misc_feature: GZ8MTXP02H9YFB.15.86.H09.1.454.CMB.2.raw
tcagtctacgtagccacgaccggtgctcgatttagtgctatagacttgggtttgggggaagaggaagactgaccggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcacttttcagtaatggctggatgagttgggtccgccaggctcgagggagggctggagtgggttggacgtttacaaaagtaaaatgatggtagaagaaaatagactacggtgcacccggtagaaaggaagattcaaccatctacaagagaattaaatacaaaaacgacggtattattcgacaaaatgaaacagacctaagaaaccgaggaacacacgccgtactattacacgtaaccacagtattacgggaagttgactagtacggaaacgtaaaagggacggtacttaagttcgtactttttagaatttactccggtcgggggacccccgaagggggaacctaaaggttcgggtaccgttcgttcttactttcgacgtccctacccaacccgaacgggcccctaagtcccggttccccttcccccgacggtcccaaccccctcccgtacaaacgccg

SEQ ID NO: 347879 - DNA, 668 bp, Homo sapiens
  misc_feature: GZ8MTXP02GQK5K.15.86.H09.1.454.CMB.2.raw
  modified_base (543)..(543): a, c, t, g, unknown or other
  misc_feature (543)..(543): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcacttttcagtaatggctggatgagttgggtccgccaggctcgagggagggctggagtgggttggacgttacaaaagtaaaatgagtggtagaagaaaatagactacggtagcaaccgtagaaaggagacttacactatctacaaagagaattaaattaacaaaaacggacggttagttatttagactaaaatagaaacagacctaaggaaaccgaggaacaacgacgtacccgtactaattacctagtaaacccactaagacttacggaaagttcgactaagtacggaacgtaaaagggagtactagtgtcttttagagttancggacggggtacccgagggaactaaggtcggtaccgtcgtctcttacacgtccctaccgaaccgtacgggcccctagtcccgttcccttcccccgtcggacccctacccctccaccgaacgaccg

SEQ ID NO: 347880 - DNA, 528 bp, Homo sapiens
  misc_feature: GZ8MTXP02IWFI9.15.86.H09.1.454.CMB.2.raw
  modified_base (392)..(392): a, c, t, g, unknown or other
  misc_feature (392)..(392): n is a, c, g, or t
  modified_base (405)..(405): a, c, t, g, unknown or other
  misc_feature (405)..(405): n is a, c, g, or t
  modified_base (498)..(498): a, c, t, g, unknown or other
  misc_feature (498)..(498): n is a, c, g, or t
  modified_base (515)..(515): a, c, t, g, unknown or other
  misc_feature (515)..(515): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaaggggacggatccccgatcgcttcatgggctccagttcgtggggctgaccgctacctccaccactctccaacctccagtctgacgatgagctgagtatcactgnggagagagccaanacaaattgatggacctaaggacgggtttgggtgttcgggacgggagggaccaagctagaccgtctaggtcacgccaaggctcgcccctcgtcnctctcgtccccacctcncgctacgtacgac

SEQ ID NO: 347881 - DNA, 533 bp, Homo sapiens
  misc_feature: GZ8MTXP02IQBNI.15.86.H09.1.454.CMB.2.raw
  modified_base (331)..(331): a, c, t, g, unknown or other
  misc_feature (331)..(331): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (521)..(521): a, c, t, g, unknown or other
  misc_feature (521)..(521): n is a, c, g, or t
  modified_base (530)..(530): a, c, t, g, unknown or other
  misc_feature (530)..(530): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccaacaccgaagggggacggatccccgatcgcttcagtgggctccagttcgnggggctgaccgctacctccaccatctccaactccagtctgacgatgagctgatancatgngganaganccanacaaattgatggaccaaaggacgggtttgggattcgggacggagggaccaaggctggaccgtcaggccagccccgaaggcctcggccccctggtccacgtctaacgttcccaccttcncgctacgtnacg

SEQ ID NO: 347882 - DNA, 693 bp, Homo sapiens
  misc_feature: GZ8MTXP02JV90R.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggacgtcccccagtatataatagaaagttaagagtgatggcagaccaacgaaccggaagggggacggacgtccccgagtccgcttcagtgggctccgagttcgtggggctcgaccgctacctccaccatcctccaacctccacgtctgacgatgaggctagatatcacgttggtaggagagacgcccaacaacgaattggaagtcggggaaccctaaaggggtccgggggtttgggggtacgggttaccgggggccggggaaacggggacccgaaacgggccgttaaccgggaccccggttaccgtaacggggttcccaaccggggacccccgaaaaggggtccccctacccgggcccccccgtttcgggtacccctaacccgtttcccgttcccggtttacccccccaaccccggtttcccctacccgggtacccttaaccgggtagtaaccccgg

SEQ ID NO: 347883 - DNA, 662 bp, Homo sapiens
  misc_feature: GZ8MTXP02G45P8.15.86.H09.1.454.CMB.2.raw
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtccttagagtctctgtgtggcctctggattcactttcagtaatggctggatgagttgggtccgccgaggctccgaggggaggggcgtggagtggggttggtacgtttacgaaaagtaaaatgagtggtagaagaaaatagacgtacggtgacgaaccgtagaaaaggaagtattaccaacctatactacgaaagaagtaaataaattaacaaaaaacggtacggttagttaatttagaactaaaagtacgaaacaacgtaccctaaaggaaaaacccggaggaaaccacgaacgcccgttacttaagttaacctaggtaacccaacgtaagaacgtttacgggaaagttcgactaacgtacggaaacggtaaagggagactaagtgttacttttagacttacgtcggtacgggacccg

SEQ ID NO: 347884 - DNA, 660 bp, Homo sapiens
  misc_feature: GZ8MTXP02FPMNV.15.86.H09.1.454.CMB.2.raw
  modified_base (485)..(485): a, c, t, g, unknown or other
  misc_feature (485)..(485): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctgggagtggggttggacgtttacaaaagtaaaatgatggtagagaaaatagactacggtgcacccgtagaaaggagattcacatctcaagagataattacaaaaacgacggtagtatttagacaaatagaacacgcctaagaaccgagacacacgccgtatacttactgtaacccacagattacggaagtagcaagtacgaacgtaaaaggnggactatgtacttttgattagtcgtcgggacccgagggacaagttgggtcgtcgttcctcgttccacgtcccctcccgaaccgaaaccggggtccccctaacgttaccccggttccccgtttcccccccgtgggaccccctacccccttaccccgttacccgaacggtaccccgg

SEQ ID NO: 347885 - DNA, 619 bp, Homo sapiens
  misc_feature: GZ8MTXP02JOJVR.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaccgaaggggacggatccccgatcgcttcagtggctcgagttcgtggggctgaccgctacctccaccactcctacccaaccccagtctgacgatgagctgagtatcactgtggagagacgaccacaactaatgatcgggaccgaaaggtacggggtttggggtgtttccggggacggggaacgggacccgaaaggtccgtacgggacccgttaccgtagggtccaacggtaccccgaaagggcccttacccggccccccgttacgggtccctaaccgttccgttcccgttcccccgtccccttcccgtccgaccttaccggtacgtacctcgggg

SEQ ID NO: 347886 - DNA, 636 bp, Homo sapiens
  misc_feature: GZ8MTXP02HB1HP.15.86.H09.1.454.CMB.2.raw
  modified_base (385)..(385): a, c, t, g, unknown or other
  misc_feature (385)..(385): n is a, c, g, or t
  modified_base (405)..(405): a, c, t, g, unknown or other
  misc_feature (405)..(405): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacacgaaggggacggatccccgatcgcttcatggctccagttcgtggggctgaccgctacctccaccatctccaacctccagtctgacgatgagctgagtancactgtggagagacgccaanactaaattgagttgggacccaaaggaccggggtttggggtcgttacggggacgggaaggggaacccaaggtcctacggtacccggttcctaaagggggtccaacggaccccgaaacggggtccctaccgggtccccccccgtcggggttacccaacccgtttccgtaacccgggtttccccccggcccctttccccggtccggtacccgttaacccggttaaggtacccgg

SEQ ID NO: 347887 - DNA, 565 bp, Homo sapiens
  misc_feature: GZ8MTXP02F6Y0A.15.86.H09.1.454.CMB.2.raw
  modified_base (405)..(405): a, c, t, g, unknown or other
  misc_feature (405)..(405): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacaccgaaggggacggatccccgatcgcttcatgggctcagttctggggctgaccgctacctccaccatctaccaacctccagtctgacgatgagctgagtatcactgaggagagagccaanactaattgatggaccaaggtacgggttgggtgttcggggacggagggaccaggcgtaggacccgtcgtaggtccgaacgcccgaaggcctcgccccccgtcggtccaccttccgtccgtttcccccggcccttccgtaccgtccgttaccgacgtaccgg

SEQ ID NO: 347888 - DNA, 547 bp, Homo sapiens
  misc_feature: GZ8MTXP02JE73I.15.86.H09.1.454.CMB.2.raw
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (535)..(535): a, c, t, g, unknown or other
  misc_feature (535)..(535): n is a, c, g, or t
  modified_base (544)..(544): a, c, t, g, unknown or other
  misc_feature (544)..(544): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaaggggacggatccccgatcgcttcagtgggctccagtttcgtggggctgaccgctacctccaccatcctaccaacctccagtcctgacgatgagctgagtatcactgnggagagancccaanaacaattggatcgggacccaaaggtcggggtttggggtagttcggggacgggagggaccaaggctacggaccgtctagggcacgcccaaggcctcgccccctggtccactctcgtccccacctcncgcttacgngac

SEQ ID NO: 347889 - DNA, 557 bp, Homo sapiens
  misc_feature: GZ8MTXP02I9WV8.15.86.H09.1.454.CMB.2.raw
  modified_base (326)..(326): a, c, t, g, unknown or other
  misc_feature (326)..(326): n is a, c, g, or t
  modified_base (382)..(382): a, c, t, g, unknown or other
  misc_feature (382)..(382): n is a, c, g, or t
  modified_base (402)..(402): a, c, t, g, unknown or other
  misc_feature (402)..(402): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaaggggacggatccccgatcgcttcatggctcagttcgngggctgaccgctacctccaccatctccacctccagtctgacagtgagctgagtacncacgtgtggagagagccaanacaaattcgatgggaccaaagggtcgggtttggggtcgttcggggacgggagggaccctaaggctcggaccgttcgagggtcacggccccaagggcctaccggcccccgttaggcctactccgtccgttcccccgcctcctcgacctacgtagcg

SEQ ID NO: 347890 - DNA, 625 bp, Homo sapiens
  misc_feature: GZ8MTXP02IAJPC.15.86.H09.1.454.CMB.2.raw
  modified_base (392)..(392): a, c, t, g, unknown or other
  misc_feature (392)..(392): n is a, c, g, or t
  modified_base (431)..(431): a, c, t, g, unknown or other
  misc_feature (431)..(431): n is a, c, g, or t
  modified_base (445)..(445): a, c, t, g, unknown or other
  misc_feature (445)..(445): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatacaacagagaccgagggaactcccccagtatataatagaaagttagagtgaatggacagaccacgaaccggaagggggaccggactccccgagtcgcttcgagtgggctccgtaggttcgtggggctcgaccgtctacctccacctactaccaccacctccgacgttcngtacagtgagtcgtagactactaccgagttggaggaagngtaaccacccaaanaacgtagttcgaacgtacggaaccgtaaagggtcggggtttgggcgggtacgggacggaacggaactaggcgtacggtacccgtacgtacggccgaacgacccgtacggtccctcccggtacccgtcgtaccttcgtcccgttcccgtccccaccgttcgtaccgtacgtacggtacgcg

SEQ ID NO: 347891 - DNA, 543 bp, Homo sapiens
  misc_feature: GZ8MTXP02FQNOE.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacaccgaagggggacggatccccgatcgcttcatggctccagttctggggctgaccgctacctccaccatctccaacctccagtctgacgatgagctgagtatcactgtggagagagccacacaattgatggaccgaaaggacgggttggggtgttcggggcggaggggaccaaggcgtcgaccgtccgtaggtcacggcccaaaggctcggccccctcggtccactcgtcgtccccgccctccctcgctacgagtacg

SEQ ID NO: 347892 - DNA, 705 bp, Homo sapiens
  misc_feature: GZ8MTXP02HTC7X.15.86.H09.1.454.CMB.2.raw
  modified_base (387)..(387): a, c, t, g, unknown or other
  misc_feature (387)..(387): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaaacagagaccagggaactcccccagtatataatagaaagttaagagtgatggcagccacaccgaaggggacggacgcccgatcgcttcagtggctccagttcgtgggctgaccgctacctcccacactcctaccaacctccagtctgacgatgagctgatancagtgtaggagagacgtaccaacaacgaaagttgaacgttcggggaaccctaaaaggggttccgggggttttagggggtcgggtttaccgggggaccggggtaaacggggaaccccgtaaaggccggtacgggtaacccccggttacccggttaggggtaccccgaacgggacccccggaaagggtccccttccccgggttacccccccgttaccggggttcccttaaccccgggtttttcccgggcccccccgttcccccgttaaccccggttcccggtaccgtttaaaccgggtacggtttaaacccgggtcgggg

SEQ ID NO: 347893 - DNA, 591 bp, Homo sapiens
  misc_feature: GZ8MTXP02HC4S4.15.86.H09.1.454.CMB.2.raw
  modified_base (470)..(470): a, c, t, g, unknown or other
  misc_feature (470)..(470): n is a, c, g, or t
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctccgagggaaggggctggagtggggtggacgtttcaaaagtaaaatgatggtagagaaaatagactacggtgcaccgtgaaaggagattcaccatctcaagagataattacaaaaacgcgtagtattgacaaaatgaaacagacctagaaaccgaggaacacagccgtatattactgtaccacagattacggaagtgcaatcgaacgtaaaggngctatgcttttgattatcgtggggcccagggacaagtggtctcgtctcttcacgtcctaccaccgtaacgggccccagttcccggtccttccccccgcgaccctaccctcctaccgaagcg

SEQ ID NO: 347894 - DNA, 614 bp, Homo sapiens
  misc_feature: GZ8MTXP02IFNP1.15.86.H09.1.454.CMB.2.raw
  modified_base (405)..(405): a, c, t, g, unknown or other
  misc_feature (405)..(405): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtaatataatagaaagttaagagtgatggcagccacgaccgaaggggacggactccccgatcgcttcatgggctcctagtcgtggggctcgaccgctacctccaccactccaccaacctccagtcctgacgatgacgctgacgtatcagttggnggagagacgaccaacaactaattgagtcggaccgtaaaggtcggggtttggggtcgtttcggggacgggacgggaaccgtaaggcgttacggacccgtcgtaggggccacgaccccgaaggccttccggcccccgttcgggtcctaactttcccgtccggtttccccccgaaccctttcccgtaccgtaccgttaacgtacgtacccgg

SEQ ID NO: 347895 - DNA, 637 bp, Homo sapiens
  misc_feature: GZ8MTXP02GFAMU.15.86.H09.1.454.CMB.2.raw
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggagggctggagtgggttggacgtttacaaaagtaaaatgatggtagaagaaaatagactacggtgccaccgtagaaaggagattcaccatctacaagagataattacaaaaacgtacggtagttatttagacaaatagaacagacctaagaaaccgaggaacacgagtcccgtactaattactagtaccacagtattacggaagtgacagtacgaagtaaaggaggtactagtgtcttttagattagtcgtacggggacccagggacaagtcggtcgtcgtctcttcgacgtccctaccgaccgaacgggtccccaacgtcccggttcccttccccccgtggcccctaccccgttcccaccgaacggtacccg

SEQ ID NO: 347896 - DNA, 646 bp, Homo sapiens
  misc_feature: GZ8MTXP02F51R2.15.86.H09.1.454.CMB.2.raw
  modified_base (491)..(491): a, c, t, g, unknown or other
  misc_feature (491)..(491): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctcgagggagggctggagtgggttggacgtttacaaaagtaaaatgatggtagaagaaaatagactacggtgcaaccgtgaaaggaagattacaccatctacaaagagaataaattacaaaaacgacggtagttatttgacaaatagaaacagacctaagaaaccgaggaacacagccgtatacttactgtaaccacagtattacggaagtgaccaagtacgaacggtaaaagnggactaatgtacttttgattagtcgtacggggacccagggaactagtcggtacgtcgtctcttcgacgtccctaccgaaccgaccgggtaccccacgttcccgggtccctttccccccgaggtacccctaccccgtaccctaccgaaacgacccg

SEQ ID NO: 347897 - DNA, 532 bp, Homo sapiens
  misc_feature: GZ8MTXP02G2UQT.15.86.H09.1.454.CMB.2.raw
  modified_base (391)..(391): a, c, t, g, unknown or other
  misc_feature (391)..(391): n is a, c, g, or t
  modified_base (405)..(405): a, c, t, g, unknown or other
  misc_feature (405)..(405): n is a, c, g, or t
  modified_base (434)..(434): a, c, t, g, unknown or other
  misc_feature (434)..(434): n is a, c, g, or t
  modified_base (442)..(442): a, c, t, g, unknown or other
  misc_feature (442)..(442): n is a, c, g, or t
  modified_base (512)..(512): a, c, t, g, unknown or other
  misc_feature (512)..(512): n is a, c, g, or t
  modified_base (519)..(519): a, c, t, g, unknown or other
  misc_feature (519)..(519): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctgatcaagctcacctgcaccctaagtagtgagcatcgaacctacaccatcgaatggtatcaacagagaccagggaacgtccccccagtatataatgaaagttaagagtgatggcagccacacgaaggggacggatccccgatcgcttcatggctccagttcgtggggctgaccgctacctccaccatctaccaacctccagtctgacgatgagctgagtatcactggnggagagagcccaanacaattgatggaccaaggacgggtttggngttcgggnggagggaccaagctggaccgtcaggtcacgcccaaggcctcgccccctggccacgtcctcgttacccccnccttccnccgactacgagcg

SEQ ID NO: 347898 - DNA, 616 bp, Homo sapiens
  misc_feature: GZ8MTXP02IKL7T.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccaggaagtccccccagtatataatgaaagttaagagtgatggcagccacgaccgaaggggacggatccccgatcgcttcatgggctccgagttcgtggggctgaccgctacctccaccatctctaacctccatctgacgatgaggctagagtatcacgtggtgggaagagacgcccaacaacaagtttgaattcgggaacccaaagggtacgggggtttggggtaggttccgggggacgggtaggggaacccaagggcctagggaaccccgtcgtaaacggcacggaccccctaaaggggccctccgggaccccccctcgggtcccaccgttccgttccgttccccctaccccttcccgtcgtcccttaaccggttacgcccg

SEQ ID NO: 347899 - DNA, 633 bp, Homo sapiens
  misc_feature: GZ8MTXP02G4L1M.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacacgaaggggacggatccccgatcgcttcatgggctccagttcgtggggctgaccgctacctccaccactctactaacctccatctgacgatgagctgagtatcacgtggaggaagagacgcccaagactaaagttgaatacgggacctaaagggtcggggtttggggtacgttacgggggacgggaaacggggtaccaagggtcctacgggaacccgttccgtaaggggccaacgggaccccaaaggggtccctaccggcccccccgtttgggtacccctaaccgtttcccgtccggtttaccccccaaccccgttcccgtaccggtacccttaacggtacggtaaccg

SEQ ID NO: 347900 - DNA, 602 bp, Homo sapiens
  misc_feature: GZ8MTXP02JL5MM.15.86.H09.1.454.CMB.2.raw
  modified_base (309)..(309): a, c, t, g, unknown or other
  misc_feature (309)..(309): n is a, c, g, or t
  modified_base (327)..(327): a, c, t, g, unknown or other
  misc_feature (327)..(327): n is a, c, g, or t
  modified_base (455)..(455): a, c, t, g, unknown or other
  misc_feature (455)..(455): n is a, c, g, or t
  modified_base (473)..(473): a, c, t, g, unknown or other
  misc_feature (473)..(473): n is a, c, g, or t
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtgggttgacgtttcaaaagtaaaatgatggtnaagaaatagactacggtncacccgtgaaaggagattcaccatctacaagagataattacaaaaacgtcggtagtatttgacaaatgaacagacctagaaacccgaggacacagccgtctattactgtaccacagattcggaaagtnacatacgaacgtaaaggngactatgtacttttgattagtcgtggggacccagggtacaagttggtcgtctcgtcttcacgtccctccacccgaacgggccctagtccggtccttcccccgtggcccacccctcctaccgaacggccg

SEQ ID NO: 347901 - DNA, 616 bp, Homo sapiens
  misc_feature: GZ8MTXP02JF53H.15.86.H09.1.454.CMB.2.raw
  modified_base (387)..(387): a, c, t, g, unknown or other
  misc_feature (387)..(387): n is a, c, g, or t
  modified_base (420)..(420): a, c, t, g, unknown or other
  misc_feature (420)..(420): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgaggggaaggggctgggagtggggttggacgtttacaaaagtaaaatgatggtagaagaaatagactacggtgacaacccgtaaaaggaagattacaccatctacaagagataaatacaaaaacgnggtatatttgaccaaatgaacagctagaaacgnggacacagccgtatatactcgtacacagattcggaatgacagtacggaacggtaaaggaggactagtgtcttttagatagtcgtggggacccagggacaagtgggtccgtcgtctctcgacgcctaccaccgaacgggcccctagtcccggtcccttcccccgtggccccacccttcccaccgaacgtacgacccg

SEQ ID NO: 347902 - DNA, 534 bp, Homo sapiens
  misc_feature: GZ8MTXP02G7VDR.15.86.H09.1.454.CMB.2.raw
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
  modified_base (502)..(502): a, c, t, g, unknown or other
  misc_feature (502)..(502): n is a, c, g, or t
  modified_base (521)..(521): a, c, t, g, unknown or other
  misc_feature (521)..(521): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacaccgaaggggacggatccccgatcgcttcagtgggctccgagttcgtggggctgaccgctacctccaccatcctccaacctccagtctgacgatgaggctgataatcgatgagggagagancccanaacaatgatggaccaaaggcgggttgggngtcgggnggacgggaccagctacgaccgtcgtaggcacgcccgaaggcctcgcccctgacnctctcgtccccaccttccncgactacgacgcg

SEQ ID NO: 347903 - DNA, 559 bp, Homo sapiens
  misc_feature: GZ8MTXP02F2LBA.15.86.H09.1.454.CMB.2.raw
  modified_base (531)..(531): a, c, t, g, unknown or other
  misc_feature (531)..(531): n is a, c, g, or t
  modified_base (547)..(547): a, c, t, g, unknown or other
  misc_feature (547)..(547): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaagggggacggactccccgatcgcttcagtgggctccagttcgtggggctgaccgctacctcccaccactcctacccaacctccagtctgacgatgagctgagtatcactggaggagagagccaacacaagttgatcgggaccaaagggtacgggtttgggtcggttcggggacggaaggggaccaaggcctacggacccgtcgtacgggtcacgcccgaaggcctcgcccccgtgcactcncgttccccgccttccncgctacgtgacg

SEQ ID NO: 347904 - DNA, 714 bp, Homo sapiens
  misc_feature: GZ8MTXP02JEWC3.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgccaccctaagtagtgagcatcgaacctacaccatcgaatggtatcaacagagaccgaggaactccccagtatataatagaaagttaagagtgatggcagccacgacggaaggggacggactccccgatcgctcagtgggctccgtagttcgtggggctcgaccgctacctcccaccactcctacctaaccctccacgtcgtacgacgtagtgaggtctagagttactcacgttggacgggagaaggacacccaaactaactaaagttggaacgttcgggaaccgtaaaggggtaccgggggtttggggtacgggttaccgggggacgggtaacggggaacccgtaaggtccggtaacggtacccccggttacggttaacgggtacccgaaccgggaccccgtaaacggggtcccgtccccgggtacccccccggttcggtacccctaaccgtttccccgttaaccccggtttacccccccaacccccggtttcccgtaccggtacccgttttaaaccgggacgtaacccgggg

SEQ ID NO: 347905 - DNA, 603 bp, Homo sapiens
  misc_feature: GZ8MTXP02G11I4.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacaccgaaggggacggactccccgatcgctcgagtgggctccagttcgtggggctgaccgctacctcccaccatcacccaacctccagtctgacgatgaggctagagtatcacgtgtggagagagacccacaactaattgatcgggacctaaagggtcggggtttgggtacgggttacgggacgggacggggaccaaggtcgtacggacccggtcgtagggtccacggaccccgaaggccctaccggccccccgttaggtcccaccgttccgtccggtttacccccgccccgttcctaccggtccgtaccgtacgtaccg

SEQ ID NO: 347906 - DNA, 586 bp, Homo sapiens
  misc_feature: GZ8MTXP02HN6AM.15.86.H09.1.454.CMB.2.raw
  modified_base (420)..(420): a, c, t, g, unknown or other
  misc_feature (420)..(420): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccagtatataatgaaagttaagagtgatggcagccacacgaaggggacggatccccgatcgcttcagtgggctcgagttcgtggggctcgaccgcctacctccaccactcctaccaacctccagtctgacgagtgaggtctgagtatcgacgttgggaggagagacgacccaanaacgtaattgaacgtcgggaccgtaaagggtcggggttttggggtggttccgggggacggggacgggaccaaggcgtcggacccgtcgtagccgacgccccgaaggcctccggcccccgtggtcctaccgtcctccgttccccgcccttccgtcgctacgtacgcg

SEQ ID NO: 347907 - DNA, 645 bp, Homo sapiens
  misc_feature: GZ8MTXP02FUBKW.15.86.H09.1.454.CMB.2.raw
  modified_base (426)..(426): a, c, t, g, unknown or other
  misc_feature (426)..(426): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaccggaaggggacggactccccaatcgcttcagtcggctccgagttcgtggggctcgaccgctacctccacctactcctacccacctccagtcgtagacgatagagtctagagtatcacgtggtaggagagacgcccaanaactaagttgacgtacgggaccgaaagggttcggggttggggtcggttacggggacgggaacgggaccgaaggtcgttacggacccggttcgtaacggggtccaaccggacccgaacgggtccgtcccggtccccccggttcgggtaacccctccgtttcccgttcccggttacccccacccccggtttcctaccggtaccgttaacggtacggtacgg

SEQ ID NO: 347908 - DNA, 677 bp, Homo sapiens
  misc_feature: GZ8MTXP02JC6KK.15.86.H09.1.454.CMB.2.raw
  modified_base (419)..(419): a, c, t, g, unknown or other
  misc_feature (419)..(419): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccgagggaacgtcccccagtatataatagaaagttaagagtgatggcagccacgaccggaaggggacggactccccgatcgcttcagtcgggctcgtacgttcggtggggcctcgaccgtctacctccccacctactcctacctaccctccgagtctagacgagtcggaggtctaggtagttaacncgaacgttgggagggaaagcgacgcccaaacacgtaattggagttacgggacctaaaggggttccgggggtttgggtaccgggttcgggggacgggaacggggacccaaggcccgttacggacccggttacgttaaggggcccaacgggaccccgaaggggtcccctaccggtcccccccggttaggtcccctaccgtttccgttaacccggttccccctacccgttcgttcccggaaccttaccggttacgacccgg

SEQ ID NO: 347909 - DNA, 625 bp, Homo sapiens
  misc_feature: GZ8MTXP02HL85L.15.86.H09.1.454.CMB.2.raw
  modified_base (326)..(326): a, c, t, g, unknown or other
  misc_feature (326)..(326): n is a, c, g, or t
  modified_base (399)..(399): a, c, t, g, unknown or other
  misc_feature (399)..(399): n is a, c, g, or t
  modified_base (411)..(411): a, c, t, g, unknown or other
  misc_feature (411)..(411): n is a, c, g, or t
  modified_base (594)..(594): a, c, t, g, unknown or other
  misc_feature (594)..(594): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaaggggacggatccccgatcgcttcatggctcagttcgnggggctgaccgctacctccaccatcctccaacctccagtctgacgatgaggctagagtatcacgtggtagganagacgacccaanaactaaattgagtacgggacccaaagggtccgggttttgggggtcggttaccgggggacgggaacgggggaaacccaagggcccttcgggaacccgtttccggtaagggtacccacggacccccgaaagggccctcccgggcccccccttcggggtccctaccgttcccttccggtacccccnccccttccgtaccgccttaacggttacgccg

SEQ ID NO: 347910 - DNA, 610 bp, Homo sapiens
  misc_feature: GZ8MTXP02JT5H6.15.86.H09.1.454.CMB.2.raw
  modified_base (451)..(451): a, c, t, g, unknown or other
  misc_feature (451)..(451): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaaggggacggatccccgatcgcttcagtgggctccagttcgtggggctgaccgctacctccaccatctccaacctccagtctgacgatgagctgagtatcacgtggtaggagagacgcccaacaacaattgatcggggaccctaaagggtcgggtttgggggnggttcgggggacgggtacgggggaacccaagggctacggacccgttcgtaacggtccaacggtccccgaaagggccctccggccccccgttcgggtacctaccttccgtccgttcccccaaccccgttccgtacccgaccgttaaccggttacgaccgg

SEQ ID NO: 347911 - DNA, 635 bp, Homo sapiens
  misc_feature: GZ8MTXP02G16SN.15.86.H09.1.454.CMB.2.raw
  modified_base (418)..(418): a, c, t, g, unknown or other
  misc_feature (418)..(418): n is a, c, g, or t
  modified_base (591)..(591): a, c, t, g, unknown or other
  misc_feature (591)..(591): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaccgaaggggacggactccccgatcgctcatgggctccgagttcgtggggctcgaccgctacctcccaccatcctaccaacctccagtctgacgagtgaggctgagtatcacgttggaggagagacgccaanacaatgatggacctaaagggtcgggttggggtcgttacgggggacggaggggaacccaaggtcgtacggaacccgttcgtaacgggtcgaaccggtaccccgaaaggggtcccctccggtacccccccgttgggggttaacccctacccgtttccgtcccgggtttccccccncccccgtttcgtacccggtaccgtttaaccggtacggtacccgg

SEQ ID NO: 347912 - DNA, 622 bp, Homo sapiens
  misc_feature: GZ8MTXP02GIMG8.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagcacacgaaggggacggactcccgatcgcttcatgggctccagttcgtggggctgaccgcctacctccccaccactcctacccaacctccacgtctgacgatgagcgtgagtatcaacgtgaggagagacgaccaacaactaattaggatcgggaccgtaaagggtcggggtttagggggtcgttacgggggacggggaaggaacccgaaaggtctacgggacccgtccgtaagggtccaacggccccgaaagggtcctaccgggccccccttacgggtcctaccttccgtcccgttaccccccacccgttcccgtacgtacccgttaacggtacgaaccgg

SEQ ID NO: 347913 - DNA, 684 bp, Homo sapiens
  misc_feature: GZ8MTXP02HLJJD.15.86.H09.1.454.CMB.2.raw
  modified_base (659)..(659): a, c, t, g, unknown or other
  misc_feature (659)..(659): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacaccgaaggggacggatccccgatcgctcatgggctccgagttcgtggggctcgaccgctacctccacccatccctacctaccctccgtacgtcgtacgacgtacgtagggacgtcgtaggtaacgtacgtaccgacggtttgggaacggggaaagaacggggaccgaacccgtaaaactaaacgttaaaggttacgagttacccgggaaacggtaaacggggttacgggggtttttgggggtaccgggttaccgggggaacggggtaaccggaaccgtaaggtccggtaaccggtacccgttacgggttacggaccgaccggacccggagtcccgtacccgtcccccggtgcctaccttccgtcccggtccccnccttacgcgtaccgtagacgtacgg

SEQ ID NO: 347914 - DNA, 617 bp, Homo sapiens
  misc_feature: GZ8MTXP02HTL2M.15.86.H09.1.454.CMB.2.raw
  modified_base (329)..(329): a, c, t, g, unknown or other
  misc_feature (329)..(329): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggactccccgatcgctcagtggctcagttcgngggctcgaccgtctacctcccaccactcctacccacctccagtctagacgatgaggctagagtatcacgttggaggagagacgaccaacaactaagttgagtacgggacccgaaagggtcggggtttggggtggttccgggggacgggaaggggaacctaagggcgtcggtaaccccggtacgtagggtaccaacggaccccgaaagggtccctacccgtcccccgtacgggtcctaccgtccgtccgttacccccgcccttcccgcgtaccgtacggtacgtaccgg

SEQ ID NO: 347915 - DNA, 630 bp, Homo sapiens
  misc_feature: GZ8MTXP02IYOBK.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgccaccctaagtagtgagcatcgaacctacaccatcgaatggtatcaacagagaccagggaacgtccccagtatataatagaaagttaagagtgatggcacgaccaacgaaccggaagggggacggactccccgatcgctcagtggctcgagttcgtgggctgaccgctacctccaccactcctaccaaccctccacgtctacgacgagtagacggtcgtagacgttatcgaacgttgggtagggaacgaaggacacccaagactaaagttgagttacgggaccgtaaagggtaccggggtttttggggcggttacgggggacggaacggggaccaaggccgtagacccggttacgtacggcaacggccccgaaggcctcccggacccccttcggcctaaccgttccgtcccgttacccccaccgtttcccgacgtccttacggtacgcg

SEQ ID NO: 347916 - DNA, 664 bp, Homo sapiens
  misc_feature: GZ8MTXP02H5QO5.15.86.H09.1.454.CMB.2.raw
  modified_base (408)..(408): a, c, t, g, unknown or other
  misc_feature (408)..(408): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggactccccgatcgctcatggctcagttcgtgggctgaccgctacctccaccatcaccacctccagtctgacgagtgaggctagagtatcagtgtagggagagacgcccaanactaaagttgaagtgggaccctaaagggtacggggtttggggttcgttacggggcggggaacgggaacccaaaggtccgtacgggtaacccccggttccgtaacgggttacccaacgggaccccctaaaggggtccctacccgggccccccgtttaccggggcccttaaccgttcccggtttccccggttaccccccccggtcccctttaccccgggttaccggtacccgtttaaccgggttaaaaccgtcccggg

SEQ ID NO: 347917 - DNA, 645 bp, Homo sapiens
  misc_feature: GZ8MTXP02HI4PL.15.86.H09.1.454.CMB.2.raw
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtgggttggacgtttacaaaagtaaaatgaatggtagaagaaaatagactacggtgcacccgtagaaaggagattcacatctcaagagataattacaaaaacgcggtagtattgacaaatgaaacagacctagaaaccgagggaacacgacgaccgtctaattactacgtaccaacagtacttacggaaagtgacatacgaacgtaaaggaggacttagtgtctttttagattactcgtacgggggcccaaggggactaagtcgggtacgtcgtctcttacgacgtccctaccgtaacccgaacgggcccctaagttcccgggtcccttcccccgtggacccctacccctcccgtaccgaaacgcccg

SEQ ID NO: 347918 - DNA, 612 bp, Homo sapiens
  misc_feature: GZ8MTXP02GYWQD.15.86.H09.1.454.CMB.2.raw
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacacgaaggggacggatcccgatcgcttcatgggctcgagtcgtggggctgaccgctacctccaccatcctccaacctccagtctgacgatgagctgagtatcactgagganagtagcccanacaatgataggccaaaggtcggggttgggtcgttacgggggcggaacggggacctaacggtcgttacggaaccccggtttccgtaaacggtccggacgaccccgaaaggggccctacccggccccccgttcgggtaaccctaccggttcccttccggttaccccccaaccctttcccgaccggtaccttaaccggttaacgacccgg

SEQ ID NO: 347919 - DNA, 674 bp, Homo sapiens
  misc_feature: GZ8MTXP02F9MDI.15.86.H09.1.454.CMB.2.raw
  modified_base (347)..(347): a, c, t, g, unknown or other
  misc_feature (347)..(347): n is a, c, g, or t
  modified_base (372)..(372): a, c, t, g, unknown or other
  misc_feature (372)..(372): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaactcccccagtatataatagaaagttaagagtgatggcagccacgacgaaggggacggactccccgatcgcttcagtggctccagtcgtggggctcgaccgctaccnccaccactcctccaacctccagtcngacgagtgagctagagttatcgacgttggtagggaagaacggacgcccaaactaaactaagtttaggacgttacggggacccgtaaaggggttacgggggtttgggggttcggttaccgggggaaccggggaaacggggaacccgaagggtcccgttacgggaccccgttaccggtaaggtacccggaaccggaccccgtaaggggcccttacccggaccccccgttcggtacctacccgttcccgtaaccggtttccccccaacccgtttccccgaccggtaccgttaacgtcggtaaccg

SEQ ID NO: 347920 - DNA, 642 bp, Homo sapiens
  misc_feature: GZ8MTXP02IGQ5F.15.86.H09.1.454.CMB.2.raw
  modified_base (271)..(271): a, c, t, g, unknown or other
  misc_feature (271)..(271): n is a, c, g, or t
  modified_base (565)..(565): a, c, t, g, unknown or other
  misc_feature (565)..(565): n is a, c, g, or t
tcagtctacgtagccacgaccggtgctcgatttagtgctatagacttgggtttggggggaagaggaagactgaccggtcccccaggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgcaggctcgaggggagggntggaggtgggtggtacgtttacaaaagtaaaatgatggtagaagaaatagactaggtgacaccgtagaaaggagatacacatctacaaagataattaaataacgaaaaacgtacggtagtatttacgactaaaatagaacacgacctaagaaaccgagaacacgacgcctactattacataccagtagatcggaagtcgactagtacgaaacggtaaaggacgtactaagtcgttacttttagattacgcggtcggggaccaagggactaagtcggtcgtcgtactctacgacnccctaccgaaccgtacggaccctacgtcccggttcccttcccccgtacgcccctacccgtacctaccgaacgtcccg

SEQ ID NO: 347921 - DNA, 552 bp, Homo sapiens
  misc_feature: GZ8MTXP02GSPI1.15.86.H09.1.454.CMB.2.raw
  modified_base (411)..(411): a, c, t, g, unknown or other
  misc_feature (411)..(411): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggactccccgatcgcttcagtgggctccagttcgtgggctcgaccgctacctcccaccactcctaccacctccagtctgacgatgagctgagtatcagtgaggagagacgccanaactaatgatggacaaaggtcgggttgggtgtcgggacggaacgggaccaaggctacggacccgtcgaggcacggacccgaaggccctcggccccctggtccactccgtcgttccccaccctccacgtactacgtagtacg

SEQ ID NO: 347922 - DNA, 587 bp, Homo sapiens
  misc_feature: GZ8MTXP02HYAW3.15.86.H09.1.454.CMB.2.raw
  modified_base (274)..(274): a, c, t, g, unknown or other
  misc_feature (274)..(274): n is a, c, g, or t
  modified_base (433)..(433): a, c, t, g, unknown or other
  misc_feature (433)..(433): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtcccccagtatataatgaaagttaagagtgaagngacagaccacgacggaaggggacggacgcccgatcgctacagtcggctctagtcgtgggctcgaccgctacctccaccactcctaccaacctccgacgtctacgaacgagtagaggactagaacgtactcgagttgggacgggaagacgacgacccaanaattaagtagagaggacgaaggtagggttgggtagggtacgggacgggaacggaacgaacgacgcgaccgtacgtacgtacgacgaccgacgcgccgcccgtccgtccgtacctcctccgtccctacccgtcctaccgaccgtacgtacgtacg

SEQ ID NO: 347923 - DNA, 586 bp, Homo sapiens
  misc_feature: GZ8MTXP02F1TGM.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacaccgaaggggacggatccccgatcgcttcatgggctccagttcgtgggactgaccgctacctccaccactctaccaacctccagtctgacgatgagctgagtatcacgtgtaggagagagccaacactaattgatggaccaaaggtcgggtggtgttcgggaggacggaccaaggcgtagaccgtacgtaggtcacgccccgaaagggccctaccggtccccccgttcgggtaccaacccgtttcgtcccggttacccccctaacccgttcccgtaccgtacctaaccggtacgaaccgg

SEQ ID NO: 347924 - DNA, 603 bp, Homo sapiens
  misc_feature: GZ8MTXP02FENXT.15.86.H09.1.454.CMB.2.raw
  modified_base (257)..(257): a, c, t, g, unknown or other
  misc_feature (257)..(257): n is a, c, g, or t
  modified_base (390)..(390): a, c, t, g, unknown or other
  misc_feature (390)..(390): n is a, c, g, or t
  modified_base (416)..(416): a, c, t, g, unknown or other
  misc_feature (416)..(416): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
  modified_base (438)..(438): a, c, t, g, unknown or other
  misc_feature (438)..(438): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatggtatacaacagagaccagggaactcccccagtatanaatagaaagttaagagtgatggcagccacaccgaagggggacggactccccgatcgacttcagtggctccgagtcgtgggggctcgaccgcctacctacccacctactcctaccctaaaccctccacggttcncgacgatgagctaggatatcacgtgngagagacnccanaacatagagnggaccaaagggtcgggttgggtggttcggggaggacgggaaccaagcgtacgacccgttcgacgggcaccggacccgaaaggccctccggcccccgtcggtaccacctttccgtcccgttcccccggtacccctcccgtaccgtacgtaaccggtacgtaaccgg

SEQ ID NO: 347925 - DNA, 567 bp, Homo sapiens
  misc_feature: GZ8MTXP02IMC1Y.15.86.H09.1.454.CMB.2.raw
  modified_base (453)..(453): a, c, t, g, unknown or other
  misc_feature (453)..(453): n is a, c, g, or t
  modified_base (553)..(553): a, c, t, g, unknown or other
  misc_feature (553)..(553): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacgaccgaagggggacggatccccgatcgctcagtgggctccgagttcgtggggctgaccgctacctccaccatcctccaacctccagtctgacgagtgagctagagtactcacgttggaggaagagacgtccaacacaaattgaatcgggacctaaaggcggggtttgggngttccggggaggacgggaccaagccgtgaacccgtcgtaggccaacggccccaaggcctccggccccctggccactccgtaaccgttcccccaccgtccncgcctacgtcgacg

SEQ ID NO: 347926 - DNA, 577 bp, Homo sapiens
  misc_feature: GZ8MTXP02IRSNR.15.86.H09.1.454.CMB.2.raw
  modified_base (399)..(399): a, c, t, g, unknown or other
  misc_feature (399)..(399): n is a, c, g, or t
  modified_base (412)..(412): a, c, t, g, unknown or other
  misc_feature (412)..(412): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggactccccgatcgcttcagtggctccgagttcgtggggctgaccgctacctccaccatcctacccaacctccacgtctgacgatgagctgagtatcagtgnggagagagccaanactaattgatggaccaagggtcgggttgggtggttcggggacggacgggaccaaggcgtacgacccgttaccgtaggtccaacgcccgaaggccctcggccccccgtggtccacccgttcgttcccgtacccctaccctccgtccgtacctacggtacgtaccgg

SEQ ID NO: 347927 - DNA, 717 bp, Homo sapiens
  misc_feature: GZ8MTXP02IMIX4.15.86.H09.1.454.CMB.2.raw
  modified_base (343)..(343): a, c, t, g, unknown or other
  misc_feature (343)..(343): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacacgaaggggacggactcccgatcgctcagtggctcagtcgtgggctcgaccgctaccnccaccatctaccacctccagtcgtacgacgtagtcgaggtcgtagagttatcgaacgttgggtagggaagaacggacgccccaaacaacgtaaatttggaagtaccggggaacccgtaaaaggggttccgggggttttagggggttacgggtttaccgggggaaccggggtaacgggggaaccccaaaggggtcccgttaaccgggaaccccggttacccgtaagggggtcccaaccgggtaccccgtaaacggggtcccgtaccccgggcccccccgtttacggggtaccctaccccggtttcccgtttaacccggtttccccccccacccgttttcccgtcccggtacctttaaaccgggtacgtaacccgg

SEQ ID NO: 347928 - DNA, 671 bp, Homo sapiens
  misc_feature: GZ8MTXP02JVZHI.15.86.H09.1.454.CMB.2.raw
  modified_base (399)..(399): a, c, t, g, unknown or other
  misc_feature (399)..(399): n is a, c, g, or t
  modified_base (419)..(419): a, c, t, g, unknown or other
  misc_feature (419)..(419): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggactccccgatcgcttcagtgggctccgagttcgtggggctgaccgctacctccaccatctaccaacctccagtcctgacgatgagctgagtatcgatggnggaagagacgaccaactaanaattgacgttgggaccctaaaagggtcggggtttggggtggtttaccgggggacgggaaggggaacccaaagggtcccgttacgggacccggtttacccgaaagggttccccgaacgggtacccccgaaaacgggggcccttcccggggaaccccccccgttcggggttaccctaacccggtttccttcccggtttaccccccctaaccctttccccggacccggtcctttaaacccggtaggtaaccccgg

SEQ ID NO: 347929 - DNA, 539 bp, Homo sapiens
  misc_feature: GZ8MTXP02FZJO9.15.86.H09.1.454.CMB.2.raw
  modified_base (324)..(324): a, c, t, g, unknown or other
  misc_feature (324)..(324): n is a, c, g, or t
  modified_base (391)..(391): a, c, t, g, unknown or other
  misc_feature (391)..(391): n is a, c, g, or t
  modified_base (399)..(399): a, c, t, g, unknown or other
  misc_feature (399)..(399): n is a, c, g, or t
  modified_base (431)..(431): a, c, t, g, unknown or other
  misc_feature (431)..(431): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccaggaacgtccccccagtatataatagaaagttaagagtgatggcagccacacgaaggggacggatcccgatcgctcatggctcagttcnggggctgaccgctacctccaccatcctaccaacctccagtctgacgatgaggctagagtatcactgngagagacnccaagacatagatggaccaaggacgggttggnggttcggggaggacggaccgaagctcggaaccgtcgtagtcacgccgaaaggcctcgcccccgtcgcctactcctaacgtccccaccttccgcgtccacgtagtaccg

SEQ ID NO: 347930 - DNA, 583 bp, Homo sapiens
  misc_feature: GZ8MTXP02IS1J9.15.86.H09.1.454.CMB.2.raw
  modified_base (410)..(410): a, c, t, g, unknown or other
  misc_feature (410)..(410): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaccgaaggggacggatccccgatccgcttcagtggctcgagttcgtgggctgaccgctacctccaccatcctacccaacctccagtctgacgatgagctgagtatcagtgaggagagcgaccanactaatagataggaccaaagggacgggtttggggtcggttcgggacggaacgggaccgaaggcctaggacccgtaccgtagggccacgaccccgaagggtcctccgtccccgtcgggtaccctaccgttcctccgttacccccacccttcccgaccgtccgtacgtaacgcgg

SEQ ID NO: 347931 - DNA, 638 bp, Homo sapiens
  misc_feature: GZ8MTXP02GS5MA.15.86.H09.1.454.CMB.2.raw
  modified_base (279)..(279): a, c, t, g, unknown or other
  misc_feature (279)..(279): n is a, c, g, or t
  modified_base (349)..(349): a, c, t, g, unknown or other
  misc_feature (349)..(349): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggnagccacaccgaaggggacggactcccgatcgctcagtcggctccagttcgtggggctcgaccgtctaccncccaccactcctaccacctccagtctgacgagtgagctagagtactcgacgtgtagggagagacgcccaagaactattagagttacgggacctaaaagggtcggggtttggggtaggttaccgggggacgggaaacgggtaccaaagggtcgtacggaccccggttacggtagggttaccaggtacccgtacgaaaccgggtcctcccggggtacccccctcgggtaccctacgttccgttacccttcccccgaaccccttccggttacccacgtttaacggtaaccgg

SEQ ID NO: 347932 - DNA, 607 bp, Homo sapiens
  misc_feature: GZ8MTXP02JRWLO.15.86.H09.1.454.CMB.2.raw
  modified_base (325)..(325): a, c, t, g, unknown or other
  misc_feature (325)..(325): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacacgaaggggacggatccccgatcgcttcatggctccagttcnggggctgaccgctacctccaccatctaccaacctccagtctgacgatgaggctgagtatcacgtgtggagagacgccaagacaattgagtcgggacctaaagggtacgggtttgggtggttcgggggacgggtaaggggaacccaaggccgttacggaccccggttcgtagggccgaacggccccgaaagggcctccggaccccccgttcgggtaccctaccgttccgttccggttccccccgccccgttccctcggtacccttaccggtaacggtacccgg

SEQ ID NO: 347933 - DNA, 678 bp, Homo sapiens
  misc_feature: GZ8MTXP02GUGEB.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttagagtgatggcagccacaccgaaggggacggatccccgatcgcttcatgggctcagttcgtggggctgaccgctacctcccaccatctaccaactccagtctgacgatgaggctgagtatcacgtgaggaagagagaccctaacaacaaattggattaggggacccaaaaggtcgggggttttgggggtacgtttcgggggaccgggaaaggggaaccccaagggacccgttacgggaaaccccggttccgtttaacgggggtacccaaaccggaccccccgtaaaagggggcccctttccgggaccccccccgtttcggggtaccctaacccggttcccttccggtttaaccccccccgtaccccctttacccggtcccggtacccttaaccgggtttaacggtaacccgg

SEQ ID NO: 347934 - DNA, 612 bp, Homo sapiens
  misc_feature: GZ8MTXP02IIMCL.15.86.H09.1.454.CMB.2.raw
  modified_base (413)..(413): a, c, t, g, unknown or other
  misc_feature (413)..(413): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagccttgatcaagctcacctgcaccctaagtagtgagcatcgaacctacaccatcgaatggtatcaacagagaccagggaacgtcccccagtatataatagaaagttaagagtgatggcagccacgaccgaagggggacggatccccgatcgcttcagtggctccagttcgtgggctgaccgctacctccaccactcctaccaacctccagtctgacatgagctagagtatcacgtggagagagacgacccaanacaaattgagtcgggaccaaagggtaccggggtttggggtcgttcggggacgggaacgggacctaaggcttacggacccgttaccgtagggtccaaacgggccccaaaggggccttacccgggccccccgttcggtacctaacccttccgttaaccgttccccccaacccgttcctaccggtccttaacggtaggaccg

SEQ ID NO: 347935 - DNA, 669 bp, Homo sapiens
  misc_feature: GZ8MTXP02IEGPO.15.86.H09.1.454.CMB.2.raw
  modified_base (414)..(414): a, c, t, g, unknown or other
  misc_feature (414)..(414): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatgtatacaacagagacaggaacgtccccagtatataatagaaagttaagagtgatggcagacacaaccgaaggggacggactcccgatcgctcgagtcggctccgagttcgtggggctacgaccgctaccaccaccatcctaccaactccagtctgacagtgagctagtagatcagtggtaggagagacgaccaaanaacgaagttgaacgtacgggacccgtaaaggggttacggggttttgggggtagggtttaccgggggaccgggaggggaaaccccgaaaggccgttaacgggaaaccccggttccgtaaggggacccctaacggacccccgaaaggggccccttacccggggacccccccgttcggggtacccttacccttccggttcccgggtttcccccccgtaccccgttcccgtaccggtacccgttaaccggtacgaccgg

SEQ ID NO: 347936 - DNA, 531 bp, Homo sapiens
  misc_feature: GZ8MTXP02J1JWZ.15.86.H09.1.454.CMB.2.raw
  modified_base (402)..(402): a, c, t, g, unknown or other
  misc_feature (402)..(402): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaagggggacggatccccgatcgcttcatgggctccagttctggggctgaccgctacctccaccatctccaacctccagtctgacgatgagctgagtatcactgtggagagagccanacaattgatggaccaaggacggttgggtgttcgggacggaggaccagctgaccgtctaggcagcccaaggcctcgccccctggtcccactcgtcgttcccccgcctacccgtcgtcctacggtactacg

SEQ ID NO: 347937 - DNA, 554 bp, Homo sapiens
  misc_feature: GZ8MTXP02F3347.15.86.H09.1.454.CMB.2.raw
  modified_base (538)..(538): a, c, t, g, unknown or other
  misc_feature (538)..(538): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatagaaagttaagagtgatggcagccacaccgaaggggacggatccccgatcgcttcatgggctccagttctggggctgacgctacctccaccatctccaacctccagtctcgacgatgagctagagtatcactgaggagagagccaacacaattgatggaccaaagggtacgggttgggtgttcggggacggaacggggaccaaagcgtaggaccgtacctaggtcacgcccgaaagggcctcgccccctggtccaccgtctaaccgttccccaccctcnccgctaccgtagaccg

SEQ ID NO: 347938 - DNA, 594 bp, Homo sapiens
  misc_feature: GZ8MTXP02JJDFN.15.86.H09.1.454.CMB.2.raw
  modified_base (416)..(416): a, c, t, g, unknown or other
  misc_feature (416)..(416): n is a, c, g, or t
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtggggttggacgtttacaaaagtaaaatgatggtagagaaatagactacggtgcacccgtagaaaggagattcaccatctcaagagataattacaaaaacgcggtagtatttgacaaatgaaacagacctagaaaccgnggaacacgagccgtactattactagtacccacagattacggaagtgacatacgacgtaaaggaggactagtgtactttgattagtcgtggggacccagggacagtggtcgtcgtctctcacgcctaccacgacggcccagtccggtcctcccccgtgccacccgtcctaccgacaccg

SEQ ID NO: 347939 - DNA, 540 bp, Homo sapiens
  misc_feature: GZ8MTXP02FO4HA.15.86.H09.1.454.CMB.2.raw
  modified_base (330)..(330): a, c, t, g, unknown or other
  misc_feature (330)..(330): n is a, c, g, or t
  modified_base (407)..(407): a, c, t, g, unknown or other
  misc_feature (407)..(407): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacaccgaagggggacggatccccgatcgcttcatgggctcagttcnggggctgaccgctacctccaccatctccaacctccagtctgacgatgaggctgatatcactgaggagagagcctaanacaattgatgggaccaaaggtcggggttgggtcgttcggggacggacgggaccaaggcgtagacccgtccgtaggcacgcccgaaggctcgccccttaggccacgtctcgtccccactcctcgctacgtcacg

SEQ ID NO: 347940 - DNA, 605 bp, Homo sapiens
  misc_feature: GZ8MTXP02I6UQ5.15.86.H09.1.454.CMB.2.raw
  modified_base (407)..(407): a, c, t, g, unknown or other
  misc_feature (407)..(407): n is a, c, g, or t
  modified_base (554)..(554): a, c, t, g, unknown or other
  misc_feature (554)..(554): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccgaggaacgtcccccagtatataatagaaagttaagagtgatggcagccacgaccgaaggggacggactccccgatcgcttcagtgggctccgtaggttcgtggggctcggaccgctacctccaccactcctccaacctccagtctacgacgatgagctgatactcacgtggnggaagagacgcccaagactaagttgattggggacctaaaggggtcggggtttggggtcgttcggggacggaacgggaccaaggtccgtacggacccgtcgtaagggccaacggtcccgaaggtccctaccgcccccgttacggaccncgttccgtcccggttcccccaaccttccgacgtccgttaacggacgtaccg

SEQ ID NO: 347941 - DNA, 593 bp, Homo sapiens
  misc_feature: GZ8MTXP02HL1DK.15.86.H09.1.454.CMB.2.raw
  modified_base (329)..(329): a, c, t, g, unknown or other
  misc_feature (329)..(329): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacagggacgtccccagtatataatagaaagttaagagtgatggacagccacaccgaaggggacggatccccgatcgctcagtgggctccgagttcgnggggctcgaccgctacctccaccatcctccaacctccagtctgacatgagctgacgtatcacgtgtggagagacgccaacacaagttgattcggaacgtaaggtacgggggtttgggacggttcggggacggaacgggaccaaggctcggaccctcgtagggccaacgacccgaagggtccctccgggtcccccgtacgggtcctaccgttccgtcccgtttacccccgacccttcccgtacgtccgtaaccggttacgccggg

SEQ ID NO: 347942 - DNA, 574 bp, Homo sapiens
  misc_feature: GZ8MTXP02JKIKX.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggatccccgatcgcttcatggctccagttcgtggggctcgaccgctacctccaccactcctaccaacctccacgtctagacgatgagctgagtactcaacgttggaggagagacgtcccaaacacaattgattcgggacctaaagggtcgggttggggtcgttcggggacggaagggaccaaaggctacggacccgtcgtagcacggcccaaggcctaccgcccccgtgccacgtcgtccgttcccccgacccttccgacgaccgtacgtagacccg

SEQ ID NO: 347943 - DNA, 619 bp, Homo sapiens
  misc_feature: GZ8MTXP02HJWYN.15.86.H09.1.454.CMB.2.raw
  modified_base (304)..(304): a, c, t, g, unknown or other
  misc_feature (304)..(304): n is a, c, g, or t
  modified_base (357)..(357): a, c, t, g, unknown or other
  misc_feature (357)..(357): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccgagggaacgtcccccagtatataatagaaagtagagtgatggcacgccacgaccggaaggggacggacnccccgagtccgcttcagtcgggcctccgagttcgtggggctcgaccgctaccnccaccatcctaccacctccagtctagacagngacgtntgtacgtatcagttgagggaagacgcgaccaacaacgtagttgagtcggacgtaagggtacgggtttggggcgttacggggacggacggaccgaggcgtacggacccgttccggagtaccgaccgaccggaaacgggtccctacccggtacccccgtcggtacctaccgttccgttaacccgtccccctaaccccttccgacgtacccgtaacggttacgaccgg

SEQ ID NO: 347944 - DNA, 550 bp, Homo sapiens
  misc_feature: GZ8MTXP02JJVKT.15.86.H09.1.454.CMB.2.raw
  modified_base (389)..(389): a, c, t, g, unknown or other
  misc_feature (389)..(389): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (402)..(402): a, c, t, g, unknown or other
  misc_feature (402)..(402): n is a, c, g, or t
  modified_base (406)..(406): a, c, t, g, unknown or other
  misc_feature (406)..(406): n is a, c, g, or t
  modified_base (432)..(432): a, c, t, g, unknown or other
  misc_feature (432)..(432): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacaccgaaggggacggatccccgatcgcttcatgggctcctagttcgtggggctgaccgctacctccaccatctaccacctccagtctgacgatgagctgagtancactgngganagnccanacatgatggaccaaggtcggttgggngttcggggacggagggaccaagcgtgacccgtcgtaggtcacggcccaagggcctccgaccccctgggtccacgtcctccgtcccccacccgttcctccgtacttaacggtacgtacg

SEQ ID NO: 347945 - DNA, 651 bp, Homo sapiens
  misc_feature: GZ8MTXP02HE8XC.15.86.H09.1.454.CMB.2.raw
tcagtctacgtagccacgaccggtgctcgatttagtgctatagacttgggtttggggggaagaggaagactgacggtccccccaggagttcgggttgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgaggggaaggggctgggagtgggttggacgtttacaaaagtaaaatgatggtgagaaaatagactacggtgcacccgtagaaaggaagattacacatctacaagagataaattacaaaaacgacggtagtatttgacctaaatgaaacagacctagaaaaccgagacacacgccgtactactactgtaaccacagattcggaatgacatacgaacggtaaaggaggactagtgtacttttgaattagtcggtcgggggacccgtaagggactaagttcgggtcgtcgtcttcttcaccgtcctaccgaccgtaaacggggcccctacgtcccgggttccccttcccccgtcggacccctaccccttccctacccgaaacggtcgaccccg

SEQ ID NO: 347946 - DNA, 737 bp, Homo sapiens
  misc_feature: GZ8MTXP02JM26D.15.86.H09.1.454.CMB.2.raw
  modified_base (302)..(302): a, c, t, g, unknown or other
  misc_feature (302)..(302): n is a, c, g, or t
  modified_base (345)..(345): a, c, t, g, unknown or other
  misc_feature (345)..(345): n is a, c, g, or t
  modified_base (393)..(393): a, c, t, g, unknown or other
  misc_feature (393)..(393): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacaccgaaggggacgganccccgatcgctcatggctcagttcgtgggctcgaccgctaccnccaccactcctaccaacctccatcagacgtagtgagcgtagagttacncgaacgtggtaggagaagacgcccaaagtaacctaaagttcggaacgttacggggaccttaaagggggtaccggggtttgggggttacggttacgggggacgggtaaacgggggacccgtaaggtcccgtagggtaaccccggttaccgtttaacgggggacctaaaacccggccccggtaaacgggggccccctttaccccggggcccccccccggttttacgggggtaccccctttaaacccggttcccccgtttaacccgggttacccccccccggttcccccgtttccccggttaccccgggtaacccgtttaacccggggtaagggtttaaacccccgg

SEQ ID NO: 347947 - DNA, 667 bp, Homo sapiens
  misc_feature: GZ8MTXP02GHRR0.15.86.H09.1.454.CMB.2.raw
  modified_base (429)..(429): a, c, t, g, unknown or other
  misc_feature (429)..(429): n is a, c, g, or t
  modified_base (637)..(637): a, c, t, g, unknown or other
  misc_feature (637)..(637): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatacgaatggtatacaacagagaccgagggaaccgtcccccagtatataatagaaagttaagagtgagtggacacgccaacgaccggaagggggacggactccccgagtcgctcagtcggctcgtagttcggtggggtctacgacccgctacctaccaccctactcctacccaaccctcctacgtcgtacgacgtagtggacgtctaggaagttacnctaagttggaggaagacgacgaccctaataacgtaagttagacgtacggggacctaaaggggtcggggtttgggggacgttaccgggggacggaacgggaaccaaggtcccggtaacggtaccccgttaccgtaagggcccgaacgaccccgagggtcccttaccccgggcccctacgggtccctaccgttccgtcccgttacccccncccgttccgtacgtaccgtacggtacgacg

SEQ ID NO: 347948 - DNA, 631 bp, Homo sapiens
  misc_feature: GZ8MTXP02IR5YU.15.86.H09.1.454.CMB.2.raw
  modified_base (330)..(330): a, c, t, g, unknown or other
  misc_feature (330)..(330): n is a, c, g, or t
  modified_base (423)..(423): a, c, t, g, unknown or other
  misc_feature (423)..(423): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggactccccgatcgctcagtggctccagttcgngggctgaccgctacctccaccactccaccaacctccagtctcgacgagtgaggctagaagtatcaacgtggtaggaagaacgacgacccaaanaactaagttggaacgtacgggaccctaaaggggtacggggttttgggggacggtttccgggggagggaacgggaccgaaaggtccgtacgggacccgttcgtaggaccaacggcccgaaagggccctcccggaccccccgttgggtccctacccgttccgtcccgtttacccccacccgttcccgtacgcccgtaacggttacgacgg

SEQ ID NO: 347949 - DNA, 684 bp, Homo sapiens
  misc_feature: GZ8MTXP02ISDVH.15.86.H09.1.454.CMB.2.raw
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggagggctggagtgggttggacgtttacaaaagtaaaatgatggtagaagaaatagactacggtgccacccgtagaaaggaagattcaccatctacaagagaattaattacaaaaacgcggtagttatttcgacaaatgaaacacgacctaagaaccgaggacacgacgtccgtactaacttactacgtaaccacgagtacgttacgggaaagtggactaagtaccggaaacgggttaaaagggaggtacttaagttcggtactttttagattagtccggtcgggggacccgaggggaactaagttcgggttaccggtcgttcttcctcacgtccctacccgaaccgacggggtacccctacgttccggttccccttcccccgtcggacccctaccccgtacccgtaccgaaacgtccg

SEQ ID NO: 347950 - DNA, 681 bp, Homo sapiens
  misc_feature: GZ8MTXP02J2LZW.15.86.H09.1.454.CMB.2.raw
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatgagttgggtccgccaggctccgagggaggggctggagtgggttgacgtttacaaaagtaaaatgagtggtagaagaaaatagacgtacggtgaccgtaacccgtggaaaaggaagtattaccaaccgattacctacgaaagtaagaaattaaacttaacgaaaaaaccggtggttagttaatttaggaactaaaattggaaactacggaccctaaaggaaaaaccccggaggtaaaccacgaacggtacccgtacttaacttaacccgtgtaaccccaacgtagtacgtttaacgggaaagtcgaacctaagttaccggaaaggttaaaacggacggtactaagttcgtacttttacggaataccgttcggacgggaaccccgg

SEQ ID NO: 347951 - DNA, 590 bp, Homo sapiens
  misc_feature: GZ8MTXP02FTOK0.15.86.H09.1.454.CMB.2.raw
  modified_base (348)..(348): a, c, t, g, unknown or other
  misc_feature (348)..(348): n is a, c, g, or t
  modified_base (412)..(412): a, c, t, g, unknown or other
  misc_feature (412)..(412): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacaccgaaggggacggactccccgatcgcttcagtggctcagttcgtggggctgaccgctaccnccaccactctccaacctccagtctgacgagtgagtctagagtatcacgtgaggagagacgccanactaatgataggaccaaggtacgggtttgggtcggttcggggacgggaacgggaccaaggcgtacggacccgtacgtagggtccacggcccgaaaggcctccggacccccgttcgggtaccaccttccgtccgttacccccacccgttcccgtccgtaccgtaccggtacgtaaccgg

SEQ ID NO: 347952 - DNA, 534 bp, Homo sapiens
  misc_feature: GZ8MTXP02HRR9A.15.86.H09.1.454.CMB.2.raw
  modified_base (328)..(328): a, c, t, g, unknown or other
  misc_feature (328)..(328): n is a, c, g, or t
  modified_base (406)..(406): a, c, t, g, unknown or other
  misc_feature (406)..(406): n is a, c, g, or t
  modified_base (442)..(442): a, c, t, g, unknown or other
  misc_feature (442)..(442): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaaggggacggatccccgatcgcttcatgggctccagttcgnggggctgaccgctacctccaccatctccaactccagtctgacgatgaggctagagtatcacgtgtggagagagccaanacaattgatggccaaaggtacgggttggtgtcgggnggagggaccaagcgtgaccgtcgtaggtcacgcccgaaggcctacgccccctcggcaccgtctcgttccccgccctctcgcgtacgtgaccg

SEQ ID NO: 347953 - DNA, 635 bp, Homo sapiens
  misc_feature: GZ8MTXP02GDKH6.15.86.H09.1.454.CMB.2.raw
  modified_base (333)..(333): a, c, t, g, unknown or other
  misc_feature (333)..(333): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacgaccgaaggggacggatccccgatcgctcagtgggctccgagttcgnggggctcgaccgctacctccaccactctaccaacctccagtctagacgagtgacgctagatatcgacgtggaggagagacgccaacactaattgatcgggacctaaagggtcggggtttgggtcggttccggggacggggaacggggacccaaaggccgttacgggaaccccggttcgttaacggggccaaacggcccccgaaaggggtcccttacccggccccccgtttgggacccaccgtttccgtcccgtttaccccccacccgtttcccgtacggtaccgttaaccggtacgtaccgg

SEQ ID NO: 347954 - DNA, 648 bp, Homo sapiens
  misc_feature: GZ8MTXP02GJE2F.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccaggaacgtcccccagtatataatagaaagttaagagtgatggcagccacgaccgaaggggacggactccccgatcgcttcagtggctccagttcgtggggctgaccgctacctccaccatcctacccaacctccagtctgacgagtgagcgtgagtactcgacgtggtacggaagagacgcccaacaacgtaagttagagtcgggaacccgtaaaggggtaccgggggttttgggggtcggttaccggggacggggtaaacggggaacccaagggtccgtacgggacccgttccgtaaggggaccaacggccccgtaaagggcccttacccgggccccccgttcgggtaccctaccgttccgttcccggttaccccccgtcccttccgtccgtaccgttaacggtacgtaccgg

SEQ ID NO: 347955 - DNA, 587 bp, Homo sapiens
  misc_feature: GZ8MTXP02G05W4.15.86.H09.1.454.CMB.2.raw
  modified_base (563)..(563): a, c, t, g, unknown or other
  misc_feature (563)..(563): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaatagactacggtgcacccgtgaaaggagattcaccatctcaagagataattacaaaaacgacggtagtatttgacaaatgaacagcctagaaaccgaggacacagccgtctattactgtaccacagattcggaagtgcatcgaagtaaaggaggctatgcttttgattatcgtggggcccaggggacaagtggtcgtcgtctcttcacgtccctccaccgaacgggccccagtccggtccttcccccgnggcccacccctcctaccaagaccg

SEQ ID NO: 347956 - DNA, 552 bp, Homo sapiens
  misc_feature: GZ8MTXP02F2VNW.15.86.H09.1.454.CMB.2.raw
  modified_base (539)..(539): a, c, t, g, unknown or other
  misc_feature (539)..(539): n is a, c, g, or t
  modified_base (549)..(549): a, c, t, g, unknown or other
  misc_feature (549)..(549): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaagggggacggactccccgatcgcttcatgggctccagtcgtggggctgaccgctacctccaccatctccaacctccagtcagacgatgagctgagtatcactggaggagagacgacccaatacaattgaatggggacccaaagggtcgggtttgggcgttcgggacgggaagggacccaaggtcacggacccgctagggccaacgcccaaaggcctcgccccctggtcacgtctcgttccccacctccncgctacgtanacg

SEQ ID NO: 347957 - DNA, 637 bp, Homo sapiens
  misc_feature: GZ8MTXP02FGU8Q.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacaccgaaggggacggatccccgatcgcttcatggctccagttctggggctgaccgcctacctccaccatctccaacctccagtctgacgatgagctgagtatcactgtggagagacgccctacgaactaagttagataggggacccaaaagggtccggggtttgggggtcggtttaccgggggacgggggaacgggggacccaaagggtccttacggaccccggttccgtaaggggtccaacgggcccccgaaagggggccccttaccggccccccccgttacgggtacccaaccttccgtcccggtttcccccaacccccgttccctcccggtacctaacggtacgtaaccgg

SEQ ID NO: 347958 - DNA, 697 bp, Homo sapiens
  misc_feature: GZ8MTXP02JE2L3.15.86.H09.1.454.CMB.2.raw
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaagggctggagtgggttggacgttacaaaagtaaaatgatggtagaagaaaatagactacggtgcacccgtagaaaggagattcaccatctacaagagaataatacaaaaacgtacggtagtattacgacaaatagaaactagacctaagaaaccgaggacacgagccgtactatactagtaccacagtagttacggaaagtgaccgaattacgaaacggtaaaagggagtacttaattaggtctttttaggaattacgttaccggtacgggggtaccccgaaggggtaactaaaggttcgggtaccgtcggttacttccgttacgtaccggtacccttacccgaaacccgtacggggaccccctaacggttccccggttcccttccccccgacggtaccccctaccccgtccctaccgaacgtaacccgg

SEQ ID NO: 347959 - DNA, 605 bp, Homo sapiens
  misc_feature: GZ8MTXP02FI0YB.15.86.H09.1.454.CMB.2.raw
  modified_base (353)..(353): a, c, t, g, unknown or other
  misc_feature (353)..(353): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
tcagtctacgtagccacgaccggtgctcgatttagtgctatagacttgggtttgggggtacttccctggtctccttctacctactgcccttcatttctccacaggtctctttgctctgcctgtgctgactcagcccccgtctgcatctgccttgctgggagcctcgatcaagctcacctgcaccctagtagtgagcatcgaacctacaccatcgaatggtatcaacagagaccagggaacgtccccccagtatataatgaaagttaagagtgatggcagccacaccgaaggggtacgggatccccggatcgcttcatggctccagttctggggctgaccgctacctcaccccntcctccacctccagtctgaaccgntgagntgagtactacagtggaggagagacgaccaacaactaatgagtcggaccgtaggtacggttggttcggtcgggacgggacgggaccgacggcgtacggtacccgtaccgtacggtaccgacgacccgaacggccctcccggtcccccgtcggtaccctacccgttccgttacccgttaacccccgaccccgtacccgtaccgtaccgtaccgtacgtacgtcgg

SEQ ID NO: 347960 - DNA, 607 bp, Homo sapiens
  misc_feature: GZ8MTXP02HST32.15.86.H09.1.454.CMB.2.raw
  modified_base (331)..(331): a, c, t, g, unknown or other
  misc_feature (331)..(331): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggacgtcccccagtataataatagaaagttagagtgatggcagccacaaccgaaggggacggatccccgatcgctcagtgggctccgagttcgnggggctgaccgctacctccaccactcctaccaacctcccagtctgacgatgaggctgagtatcacgtgtggagagacgccacacagttgagtggaccgtaaggtacgggtttggggcggtttacggggcgggacggggaaccgaacggccgtacggtaaccgtccgtaagggtccgaacggaccccgaaacgggcctcccggccccccgtcgggtcctacccgtccttccgttccccctaccccgttcccgtccgtacccgtacggttacggaccg

SEQ ID NO: 347961 - DNA, 672 bp, Homo sapiens
  misc_feature: GZ8MTXP02FX1AW.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatagaaagttaagagtgatggcagccacaccgaaggggacggatccccgatcgcttcatggctccagttcgtggggctcgaccgcctacctcccaccactctacccaacctcccagtcctgacgatgaggctgagtaatccagtggtagggagagtacggcccaacgaactaaagttgaacgttagggaccctaaaaggggtccggggtttagggggttcggttcgggggaccgggaaaggggaaccctaaagggtccgttacgggaaccccgttccgttaaaggggtcccaaaacgggtcccccgaaaagggggtccccttccgggaccccccccttggggtacccaccgtttcccgtccggttttccccccgccccctttcccgtccggaccttaaccggggttacgaacccgg

SEQ ID NO: 347962 - DNA, 618 bp, Homo sapiens
  misc_feature: GZ8MTXP02H76XC.15.86.H09.1.454.CMB.2.raw
  modified_base (296)..(296): a, c, t, g, unknown or other
  misc_feature (296)..(296): n is a, c, g, or t
  modified_base (358)..(358): a, c, t, g, unknown or other
  misc_feature (358)..(358): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagacagggaacgtcccccagtatataatgaaagttaagagtgatggcagccacacgaaggggacgganccccgatcgcttcagtggctcagttctggggctgaccgctacctccaccactctcccaaccnccagtctgacgatgagctaggatatcacgtgtaggagagacgaccacaacaaattgagtaggacccaaagggtcgggtttggggtcggttacgggacggggacggggaaccaaaggccgttacggacccggttacgtacgggttacccgaacgccccggaaaggccgttacccggccccccgtacgggtaccctcccgttccgtcccggtttcccccgtaccccgttcccgtccgacccgttaaccggttacggtaccgg

SEQ ID NO: 347963 - DNA, 596 bp, Homo sapiens
  misc_feature: GZ8MTXP02GGG1L.15.86.H09.1.454.CMB.2.raw
  modified_base (410)..(410): a, c, t, g, unknown or other
  misc_feature (410)..(410): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacaccgaaggggacggatccccgatcgcttcatgggctccagttcgtggggctgaccgctacctccaccatctccaacctccagtctgacgatgagctgagtatcacgtgtaggagagacgccaanacaaattgatagggaccaaagggtcgggttgggggtcggttcgggggacgggacggggaccaaaggccttacgggacccgttaccgtaggggtacacggaccccgaaaggcccttccgcccccgttcgggcctaccttccgtccgttacccccacccgttccctcggaccttaacggtacgtaccg

SEQ ID NO: 347964 - DNA, 597 bp, Homo sapiens
  misc_feature: GZ8MTXP02JVGG0.15.86.H09.1.454.CMB.2.raw
  modified_base (302)..(302): a, c, t, g, unknown or other
  misc_feature (302)..(302): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacaccgaaggggacggganccccgatcgcttcagtgggctcagttcgtggggctgaccgctacctccaccatctaccaacctccagtctgacgatgagctgagtatcactgtggagagacgccaacacaattgactgggaccaaagggtcgggtttggggtcgttcggggagggacggggaccaaggcgtacggtacccgtaccgtagggccgaacggcccgaaaggtccgtccggccccccgttcgggaccttacccgtcgttccgttaccccccacccgttccgtaccggaccttaacggtacgtaaccggg

SEQ ID NO: 347965 - DNA, 654 bp, Homo sapiens
  misc_feature: GZ8MTXP02IO1FK.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacggatccccgatcgcttcatgggctccgagttcgtgggctgaccgctacctccaccatcctaccaacctccagtctgacgagtgaggctgagtactcacgttgaggagagacgcccaagaacaaagttgagttacggaccctaaagggtaccggggtttgggggttcggttacgggggaccggggaacgggaacccgaagggtccgtacggaccccgttaccggtagggtacccgaaccggacccccgaaagggcccgttacccggcccccccgttacgggtcccctaacctttcccgttccggtttacccccccacccgtttccccgtacggtccctttaaccggtacgtaacccgg

SEQ ID NO: 347966 - DNA, 765 bp, Homo sapiens
  misc_feature: GZ8MTXP02J3HWA.15.86.H09.1.454.CMB.2.raw
  modified_base (713)..(713): a, c, t, g, unknown or other
  misc_feature (713)..(713): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaacgccgtgggggtcccttaggagtctcctgtgtgcctctgattctacttcagtaatggctaggatggtaggttcgggtccgccgagggcctaccgggaggggaacggggctagggaggtggggttgaacgtttacgaaaaagttaaaatgaagtggtagaagaaaagtagacgtacggtcgaccgtaacccggtagaaaacgggtaacacgttaccaaccctatttaccgtaaccaaaagggtaaagtaaattaaaacgtttaaccgaaaaaaaacccggggtcgtttaggttaattttacggaaacctaaaaacggttacggaaaacctaacgggacccttaaacgggaaaaacccccggtagggaaacccaaccggaaacggtccccgttacgtttaaactaaccgtacggtaaaccccaacgaacgtagtttaccggggaaaattcggaacctaagttaaccggaacggtaaaaggngtccgtaagttggtccttttaggaacttcggttaccggacgggtaaccccgg

SEQ ID NO: 347967 - DNA, 660 bp, Homo sapiens
  misc_feature: GZ8MTXP02IYZ3H.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatacgaacctacaccatacgaatggtatacgaacggagaccgagggaaccgtccccagtatataatagaaagtaagagtgatggcacgaccacgaacgaaggggacggactcccgatcgctcgagtggctcgtagttcgtggctcgaccgctacctcacccctactcctaccctaaccctctacgtctagacgagtcgagcgtagatactcgacgtggtaggagagaaccgaccaacaacgtaaagttggaacgtacgggaaccgtaaagggggttcggggtttcgggggttacggtacccgggggaacgggggaaacggggaacccgtacggccggttacggaaccgtacggtaccgtacggaccgaccgtaccgggcgtcccgtccccgtacccggtcgtaccctccgttcccgtccccgtcccccacccgttccgccgtaccgttacggactaccgggg

SEQ ID NO: 347968 - DNA, 678 bp, Homo sapiens
  misc_feature: GZ8MTXP02F8DDF.15.86.H09.1.454.CMB.2.raw
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggagggctggagtgggttggacgttacaaaagtaaaatgatggtagaagaaaatagactacggtgacaccgtagaaaggagatcaccatctacaagagaataactaacgaaaacgtaggtagtatttacgactaaatagaacagaccgtaagaaccgagacacgagccgtactattacacgtaccagagtagtcggaaagtcactagtacggaacggaaagcggtactagtgttactttagattacgtcgtacggggacccgagggacctaaggttcggtccgttacgttcctacgtttaccgacgtcccccgtaaccgaaccggtaaccggggcccctaacggtttccccggttccccgtttaccccccggtggtcccccaacccccgttccgtaacccgaaacggtccccg

SEQ ID NO: 347969 - DNA, 708 bp, Homo sapiens
  misc_feature: GZ8MTXP02HT7PT.15.86.H09.1.454.CMB.2.raw
  modified_base (465)..(465): a, c, t, g, unknown or other
  misc_feature (465)..(465): n is a, c, g, or t
  modified_base (509)..(509): a, c, t, g, unknown or other
  misc_feature (509)..(509): n is a, c, g, or t
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttggtccgccaggctccgagggagggctggaggtgggttggtacgtttacaaaaagtaaaatgatggtagaagaaatagactacggtgaccaaccggtagaaaggagattaccaaccatactacaaagagtaataaacttaacgaaaaacggtacggtagttaatttagactaaaatgaaacagacctaagaaccgagaacacgagtcccgtatattaacngaaccagagtatacggaagtgacctagtaccgaaaggtaaaggngtacttagtacgtttcttttagaattacgtccggtacggggaccccaaggggaacctaaggtcggttacgtccgttcttacgttacccgaacgtcccgtaacccgtaaaccgaccggggtaaccccctggtttccccgggtaacccccttttcccccggagttacccccaccccctttacccgaaccgtaaccggaccg

SEQ ID NO: 347970 - DNA, 679 bp, Homo sapiens
  misc_feature: GZ8MTXP02I20SK.15.86.H09.1.454.CMB.2.raw
  modified_base (392)..(392): a, c, t, g, unknown or other
  misc_feature (392)..(392): n is a, c, g, or t
tcagtctacgtagccacgaccggtgctcgatttagtgctatagacttgggtttgggggacttccctggtctccttctacctactgcccttcattttctctacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggatccccgatcgcttcagtcgggctccaggttcgtggggctgaccgctacctccaccatcctacccaacctccagtctgacgatgagctgattancatggaggagagacgacccaacaacaaagttgaacttcggggaaaccctaaaggggtaccgggggtttggggtaccgggtttacgggggaccggggaaggggtacccaaagggtcccgtaacgggacccccggttacgtaacgggtcccgaacggacccccgaaaaggggtccccgttccgggaccccccccgtttcggggtaacccacccgtttcccgttaacccggttttacccccccaacccgtttccccgttaccggacccgttaccggttaaccgtaaccgg

SEQ ID NO: 347971 - DNA, 544 bp, Homo sapiens
  misc_feature: GZ8MTXP02FE69A.15.86.H09.1.454.CMB.2.raw
  modified_base (332)..(332): a, c, t, g, unknown or other
  misc_feature (332)..(332): n is a, c, g, or t
  modified_base (407)..(407): a, c, t, g, unknown or other
  misc_feature (407)..(407): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacaccgaagggggacggatccccgatcgcttcatgggctccagttcgnggggctgaccgctacctcccaccatctccaacctccagtctgacgatgagctgagtatcactgtgagagagccanacattgatggaccaaggacggttgggtgttcggggacggacgggaccaaggctaggaccgtcgtaggtcacgcccaaggctacggccccctcggtccacgttcgtcgttccccgaccctcctccgactacgcgtacg

SEQ ID NO: 347972 - DNA, 385 bp, Homo sapiens
  misc_feature: GZ8MTXP02F8L3L.15.86.H09.1.454.CMB.2.raw
  modified_base (358)..(358): a, c, t, g, unknown or other
  misc_feature (358)..(358): n is a, c, g, or t
  modified_base (382)..(385): a, c, t, g, unknown or other
  misc_feature (382)..(385): n is a, c, g, or t
tcagtctacgtagccacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgttcccatcgactacgcctttcggcctcgccttaggggtcactcaccctgccccgattaacgtgacaggacccttggtctccggngagcgggctggcaaggcgcatagnnnn

SEQ ID NO: 347973 - DNA, 547 bp, Homo sapiens
  misc_feature: GZ8MTXP02JAKY6.15.86.H09.1.454.CMB.2.raw
  modified_base (131)..(131): a, c, t, g, unknown or other
  misc_feature (131)..(131): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgacncagcccccgtctgcatctgccttgctgggagcctcgatcaagctcacctgcaccctaagtagtgagcatcgaacctacaccatcgaatggtatcaacagagaccaggagtccccagtatataatgaaagtagagtgatggcagccacgaccgaaggggaccggatccccgatcgcttcgatcggatccagggttcctggggcctgaacccgtctacctccacccactactccaaccttccagtccagtcgaagtcgaggctagacgtaatcgtacgagtgaacggagagcccacacaaattgataggtccaaaggacgggttgggtgtcgggcggagggaccaagctgaccgtctaggcagcccaaaggcctcgccccctcggtcacctctcgtccctccacgcctcgtagcctgg

SEQ ID NO: 347974 - DNA, 636 bp, Homo sapiens
  misc_feature: GZ8MTXP02IE730.15.86.H09.1.454.CMB.2.raw
  modified_base (271)..(271): a, c, t, g, unknown or other
  misc_feature (271)..(271): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgccccgtctgcatctgccttgctgggagcctcgatcaagctcacctgcaccctaagtagtgagcatcgaacctacaccatcgaatggtatcaacagagacaggaacgtccccagtatataatagaaagtagagtganggcagaccacgaccggaaggggacggactcccgatcgctcagtggctcgtagttcgtgggctacgaccgctaccnccaccnctcctaccacctccatcgtgacgagtgacggctagagtatcgagtggagagagacgcccaaatacaaagttgacgtacgggaacccgtaaaggggtccgggggtttggggtacgggtttaccgggggacggggtaacgggaaccgaaggtccgtacggtaccggttaccgaggtccgaccgacccggaacggtccgtaaccccgtcccccgttacgggtaccctctttccctccggtttacccccaccggttccctacggtacccgttaagttacggtaaccgg

SEQ ID NO: 347975 - DNA, 629 bp, Homo sapiens
  misc_feature: GZ8MTXP02IHEVG.15.86.H09.1.454.CMB.2.raw
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (410)..(410): a, c, t, g, unknown or other
  misc_feature (410)..(410): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggactcccccagtatataatgaaagttagagtgatggcagccacaccgaaggggacggactccccgatcgcttcagtggctccgagttcgtgggctcgaccgctacctccaccntccnccaacctccagtctcgacgactgacggctgatatcgattgaggacagacgtccaanacaaattgatcgggacctaaaggtacggggtttgggtacggttcggggacggaacggggaacccaaggccctacgggtaccccgtccgttaaagggggcccaacggacccccgaaagggtccccttcccgggcccccccttacggggtacccctaccgttcctaaccggtttaccccccaaccccgttcgaccggtaccctaaacggttacgaacccgg

SEQ ID NO: 347976 - DNA, 604 bp, Homo sapiens
  misc_feature: GZ8MTXP02GMA4E.15.86.H09.1.454.CMB.2.raw
  modified_base (491)..(491): a, c, t, g, unknown or other
  misc_feature (491)..(491): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctggggggagccttggtaaagcctggggggtcccttagagtctcctgtgtggcctctggattcactttcagtaatggctgggatgagttgggtccgccgaggctcgagggaggggctggagtgggtggacgtttacaaaagtaaaatgatggtagaagaaatagactacggtgcaccgtagaaaggagattcgaccatctacaagagataattacaaaaaacgtcgtatattgacaaaatagaacagcctagaaccgagacacgagccgtatactactgtaccacagacttcggaaagtgacctagtccggaagtaaaggcggtataagttgnttttagatacgtcgtcggggacccaggggacaagtcggtacgtcgtctcttacacgtcctaccacgacggcccagtccggtcctaccccgtggacccaccctcaccaacggcg

SEQ ID NO: 347977 - DNA, 523 bp, Homo sapiens
  misc_feature: GZ8MTXP02JSLAM.15.86.H09.1.454.CMB.2.raw
  modified_base (406)..(406): a, c, t, g, unknown or other
  misc_feature (406)..(406): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaaggggacggatccccgatcgctcatgggctccagttcgtggggctgaccgctacctccaccatcctaccaacctccagtctgacgatgagctgagtatcatgtaggagagagcccaanacaattgatggaccaaggacggttgggtgttcgggcggaggaccaagctgaccgtctaggcacgcccaaggcctcgccccctgtccactctcgttcccgccctctcgctacgagacg

SEQ ID NO: 347978 - DNA, 626 bp, Homo sapiens
  misc_feature: GZ8MTXP02H685F.15.86.H09.1.454.CMB.2.raw
  modified_base (254)..(254): a, c, t, g, unknown or other
  misc_feature (254)..(254): n is a, c, g, or t
  modified_base (284)..(284): a, c, t, g, unknown or other
  misc_feature (284)..(284): n is a, c, g, or t
tcagtctacgtagccacgaccggtgctcgatttagtgctatagacttgggtttggggagctctgggagaggagcccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagngtctctgtgtgcctctgatcacttcagtangctggatgagttggccgccgaggctcgagggagggcgtggagtgggtgtacgttacgaaaagtaaaagtgagtaggtagaagaaaatagacgtacggtcgaccgacccgtaggaaaggagaacttaccgacctatactacaaagagaattaaacgtaacgaaaaacgacggttagtatttagactaaaagtacgaacgacgaccgtaaaggaaaacccgagaaccacgacgaccgtactacttactacgtaccacgagtagtacggaagtgcgaagacggtaacgtaaaaggcgtactaagttcgttacgtttagtaagttcgtaccgtacgggggtacccg

SEQ ID NO: 347979 - DNA, 646 bp, Homo sapiens
  misc_feature: GZ8MTXP02HNYPC.15.86.H09.1.454.CMB.2.raw
  modified_base (352)..(352): a, c, t, g, unknown or other
  misc_feature (352)..(352): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaagggggacggactccccgatcgcttcagtgggctccgagttcgtggggctcgaccgctaccnccaccatcctacccaacctccagtctgacgatgagctgagtatcgatggtaggacgaagacgccctaacaacaagttgaacgtgggaaccctaaagggttacgggggttttgggggtacggttaccgggggacggggacgggggaaacccaagggccgttcgggaaaccccgtttccgaaagggtcccaacggacccccggtaaaggccccttccgggcccccccttgggtacccaccgttcgttaacccgttcccccaacccttcccgtacgtaccgtaacgttagaacccgg

SEQ ID NO: 347980 - DNA, 590 bp, Homo sapiens
  misc_feature: GZ8MTXP02IJR5B.15.86.H09.1.454.CMB.2.raw
  modified_base (398)..(398): a, c, t, g, unknown or other
  misc_feature (398)..(398): n is a, c, g, or t
  modified_base (413)..(413): a, c, t, g, unknown or other
  misc_feature (413)..(413): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccaggaacgtcccccagtatataatagaaagttaagagtgatggcagccacaccgaaggggacggactccccgatcgctcagtggctccagttcgtgggctcgaccgctacctccaccactctaccaacctccacgtctgacgatgaggctgagtatcacgttgnggagagacgcctaanactaaattgagtcggacctaaaggtcgggtttggggtcgtttcggggacggacgggtacaaggcgtacggaccgtcgtaggtccacggtcccgaaagggccctccggcccccgttgggtacctacgttcccgtcgttccccccgcccttccgtaccggtccttaacggtacgtacgg

SEQ ID NO: 347981 - DNA, 638 bp, Homo sapiens
  misc_feature: GZ8MTXP02HZ4MM.15.86.H09.1.454.CMB.2.raw
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgaggggaaggggctgggagtggggttggacgtttacaaaagtaaaatgatggtagaagaaatagactacggtgcaccgtagaaaggagatcaccatctacaagagataatacaaaaacgtacggtagtatttgacaaatgaaacagacctagaaccgagaacacagcctactattactagtaccacagtattacggaagtgacatcgaacgtaaagaggcttatgtctttttgattagtcgtcgggggccagggtacaagttcgggtcgtcgtcttcttcgacgtccctaccgaaccgacggggtccccctaagttcccgggttaacccctttccccccgtcggcccctaaccccctccctacccgaaacggacccg

SEQ ID NO: 347982 - DNA, 568 bp, Homo sapiens
  misc_feature: GZ8MTXP02HZYY8.15.86.H09.1.454.CMB.2.raw
  modified_base (414)..(414): a, c, t, g, unknown or other
  misc_feature (414)..(414): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagacagggaacgtcccccagtatataatagaaagttaagagtgatggcagccacgaccgaaggggacggactccccgatcgctcagtgggctcagttcgtgggctgaccgctacctcccaccatctaccaacctccgacgctgacagtgagctagagtactcagttgacggagagagacccaaanactaagtgagtcggaacgtaagggtcgggttgggtcggtacggggacggaacggaacgagccgtacggaccgtacgtaggcgacgaccgacgcctcccgccccgtgcctaccgtccgtcccgtacccctacctcccgacgtccgtacgtacgcg

SEQ ID NO: 347983 - DNA, 577 bp, Homo sapiens
  misc_feature: GZ8MTXP02I0A7F.15.86.H09.1.454.CMB.2.raw
  modified_base (374)..(374): a, c, t, g, unknown or other
  misc_feature (374)..(374): n is a, c, g, or t
  modified_base (403)..(403): a, c, t, g, unknown or other
  misc_feature (403)..(403): n is a, c, g, or t
  modified_base (424)..(424): a, c, t, g, unknown or other
  misc_feature (424)..(424): n is a, c, g, or t
tcagtctacgtagccacgaccggtgctcgatttagtgctatagacttgggtttgggggaagaggaagactgacggtccccccaggagttcgggctgagctgggtttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctccagggaagggctggagtgggttggacgtttcaaaagtaaaatgatggtagagaaatagactacggtgcaccgtgaaaggagattcaccatctcaagagataattcaaaaacgcggtntattgacaaatgaacagcctagaaaccgnggacacagccgtctacttacngtaaccacagattcggaatgcatcgaacgtaaaggagactagtgcttttagattagtcgtcggggacccaggggtacagttggtcgtcgctctcacgcctccaccgacggcccatccggtcctccccctaggcccacccgtccctcgaacgcg

SEQ ID NO: 347984 - DNA, 631 bp, Homo sapiens
  misc_feature: GZ8MTXP02HF58F.15.86.H09.1.454.CMB.2.raw
  modified_base (301)..(301): a, c, t, g, unknown or other
  misc_feature (301)..(301): n is a, c, g, or t
  modified_base (505)..(505): a, c, t, g, unknown or other
  misc_feature (505)..(505): n is a, c, g, or t
  modified_base (593)..(593): a, c, t, g, unknown or other
  misc_feature (593)..(593): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatgtatacaacagagacagggaacgtcccccagtatataatagaaagtaagagtgatgacagccacaccggaaggggacggacnccccgatcggcttcagtcggctcgtagtcgtgggctcgaccgctacctcccacctactacctaccctaacctccagtcgtacgacgtagtagagtcgtagtagtactccaaggttggacgggagaggtacacccaactaagtaagttgaacggtgaaccggagggttaccggggttgggtacggtccggggagggtacgaccgnggctacgtacccggtcgagggtaccacggacccgagggtccctaccccgtaccccggtcgtaccaccgttccgttccccggttccccnccccgttaacccggcaccgtaaccggttcaacccgggg

SEQ ID NO: 347985 - DNA, 660 bp, Homo sapiens
  misc_feature: GZ8MTXP02HHB6I.15.86.H09.1.454.CMB.2.raw
  modified_base (381)..(381): a, c, t, g, unknown or other
  misc_feature (381)..(381): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaaggggacggatccccgatcgcttcagtggctcgagttcgtggggctgaccgctacctccaccatcctaccacctccagtctgacagtgagcngagtatcacgtgtaggagagacgaccaacaactaaagttgaatcgggaccctaaagggtaccggggtttggggtacggttccgggggacggggaacggggaacccgtaaaggccgtacggtaaccccggttaccgtaacggggtccaacgggaccccgaaaggggcccgttaccgggtcccccccgttcggggttccctacccgtttcccgttcccggtttccccccaaccccgttcccccgttacccggtacccgtttaaccggtacggtaaccccgg

SEQ ID NO: 347986 - DNA, 666 bp, Homo sapiens
  misc_feature: GZ8MTXP02GFB28.15.86.H09.1.454.CMB.2.raw
  modified_base (223)..(223): a, c, t, g, unknown or other
  misc_feature (223)..(223): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggaggtctggggganccgttgggtaaagccgtggggggtcccttaggagtctcctgtgtggcctctggattcactttcagtaatggctggatgagttggtccgcaggctcgagggagggctggagtggggtggacgtttacaaaagtaaaatgatggtagaagaaaatagacgtacggtgaccacccgtggaaaagagattaccgacctatactacaaagagtaataaacttaacaaaaaacggtacggttagtaatttagactaaaatacgaaacaaggtaccccgtaaaggaaaaaccccggaggaaccaaaccgacgaccccgttacttaacttaaccgtacgtaaccaacgtaagtaacgtttacggggaaaagttcggaaccaagttacggaaacggttaaaagggcggtactaagttgtacttttagacttacgtccggtacggggaacccg

SEQ ID NO: 347987 - DNA, 621 bp, Homo sapiens
  misc_feature: GZ8MTXP02G8AB5.15.86.H09.1.454.CMB.2.raw
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaagggctggagtggggttggacgtttacaaaagtaaaatgatggtagaagaaaatagactacggtgcaccgtagaaaggaagatcaccatctacaagagataattacaaaaacgacggtagtatttgactaaatgaacagacctagaaaccgaggaacacagccgtactatactgtaccacagtatcggaagtgacatacgaacgtaaaggagactatgtctttagattagtcgtcggggacccgagggacaagtcggtacgtcgtctcttcacgccctaccgaccgaacgggcccctagttcccggtaacccgttcccccgtcggtaccccacccctacccgtaccaaacgccg

SEQ ID NO: 347988 - DNA, 597 bp, Homo sapiens
  misc_feature: GZ8MTXP02G31OA.15.86.H09.1.454.CMB.2.raw
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (455)..(455): a, c, t, g, unknown or other
  misc_feature (455)..(455): n is a, c, g, or t
  modified_base (487)..(487): a, c, t, g, unknown or other
  misc_feature (487)..(487): n is a, c, g, or t
  modified_base (579)..(579): a, c, t, g, unknown or other
  misc_feature (579)..(579): n is a, c, g, or t
  modified_base (585)..(585): a, c, t, g, unknown or other
  misc_feature (585)..(585): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggagggctggagtgggtgacgtttacaaaagtaaatgatggtagaagaaatgactacggtgccacccgtagaaaggaagtacttacaacctatctacaagagtaataattacaaaaacgtggtagtatttaccganaaatgaaacngacctaagaaaccgagaacacagtccgtatatacctagtaccanagattacggaagtgacataccgaagtaaaggngtactatgtctttgaattgtcgtacgggcccaagggactagtcggtcgtcgtctactcgagtcccacacgacggtccagtccgtcctcccgngacccnccctcaccagcc

SEQ ID NO: 347989 - DNA, 641 bp, Homo sapiens
  misc_feature: GZ8MTXP02HGMGD.15.86.H09.1.454.CMB.2.raw
  modified_base (399)..(399): a, c, t, g, unknown or other
  misc_feature (399)..(399): n is a, c, g, or t
  modified_base (432)..(432): a, c, t, g, unknown or other
  misc_feature (432)..(432): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaagggctggagtgggttggacgtttacaaaagtaaaatgatggtagagaaaatagactacggtgcacccgtgaaaggagattcaccatctacaagagataaattacaaaaacgacggtagtattgacaaatanaacagacctagaaaccgaggacacgtagccgtntattactagtaccacaagagttacggaaagtgacagtacgaacgtaaaaggaggtactagtgtacttttgattagtcgtcggggccaggggactaagtcggtcgtcgtcttcttcgacgtccctacccgaccgaacggggtccccaagttcccgggtccctttcccccggtcggacccctacccccgttaccctaccgaaaacgacccg

SEQ ID NO: 347990 - DNA, 604 bp, Homo sapiens
  misc_feature: GZ8MTXP02JNCPS.15.86.H09.1.454.CMB.2.raw
  modified_base (142)..(142): a, c, t, g, unknown or other
  misc_feature (142)..(142): n is a, c, g, or t
  modified_base (408)..(408): a, c, t, g, unknown or other
  misc_feature (408)..(408): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtntgcatctgccttgctgggagcctcgatcaagctcacctgccacctaagtagtgagcatcgaacctacaccatcgaatggtatacaacagacgaccgagggaactccccagtactataatagaaagttaagagtgatggcacgccacgaccggaaggggacggactcccgatcgtctcagtggctcgtagttcggtgggctcgaccgcctaccacccaccactcctaccacctcgacgtcgtacgacgtagtagagcgtagacttancgacggttgaggacaaggtaccacctaacgtataagttgacgtacggaccgtaaagggtcgggttggggacgtcgggaacgaacgggacaagtcgtacgacgttacgagccacgaccgtaggcctccggccccgttagacccttccgccgttccggtccccctaaccgttccacggtaccttaacggacgtccggg

SEQ ID NO: 347991 - DNA, 649 bp, Homo sapiens
  misc_feature: GZ8MTXP02FUANO.15.86.H09.1.454.CMB.2.raw
  modified_base (615)..(615): a, c, t, g, unknown or other
  misc_feature (615)..(615): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccaggaacgtcccccagtatataatagaaagttaagagtgatggacagccaacgaccgaacgggggacggacgtccccgatcgcttcagtggctccgagtcgtggggctcgaccgctacctccacctatcctaccaacctccacgtcgtacgacgtagtcgacggtctagattacgtcacgtggtaggagagacgccaacaactaattagagttacgggacccgtaaagggtaccggggtttgggggttacgggttaccgggggacggggtaaacggggaccctaaaggtccgtacgggtacccgtaccgtacgggtccgaacgacccgaaacggccgtacccggcccccgtcggtaccaccgttccctccgtttacccccnccccgttaccgtccgtaccctacggtacgtaccg

SEQ ID NO: 347992 - DNA, 583 bp, Homo sapiens
  misc_feature: GZ8MTXP02GD120.15.86.H09.1.454.CMB.2.raw
  modified_base (331)..(331): a, c, t, g, unknown or other
  misc_feature (331)..(331): n is a, c, g, or t
  modified_base (357)..(357): a, c, t, g, unknown or other
  misc_feature (357)..(357): n is a, c, g, or t
  modified_base (396)..(396): a, c, t, g, unknown or other
  misc_feature (396)..(396): n is a, c, g, or t
  modified_base (407)..(407): a, c, t, g, unknown or other
  misc_feature (407)..(407): n is a, c, g, or t
  modified_base (542)..(542): a, c, t, g, unknown or other
  misc_feature (542)..(542): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaccgaaggggacggatccccgatcgcttcatgggctccagttcgngggctgaccgctacctccaccactcnccaacctccagtctgacgatgagctagagtatcacgtgnggaagaggacncccaaagactaaagttcgagtcgggaacccaaaggtacggggtttgggtcggttacggggacgggaacggggaccaaggctacggacccgtacgtagggccacggacccgaagggcctccggccccctggtaccnccgttctccgttccccacccgtctcgacgtacgacgtacgg

SEQ ID NO: 347993 - DNA, 688 bp, Homo sapiens
  misc_feature: GZ8MTXP02G77C0.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgagtggcagccacaccgaaggggacggactccccgatcgcttcagtcggctcctagttcgtgggctcgaccgcctactcccaccactcctaccaacctccacgtctgacgtagtagaggtcgtgaagttactcctacgttggaggggaagaggacgacccaacgaaactaattacggagtacgggacccgaaagggtacgggggtttgggggtgggtttaccgggggacggggaaccggggacccgaaagggtccgtacgggtaccccggtcgttaacgggaccgacggacccccggaaggcccgttcccggcccccccgttcggggtaccctaacccgtttcccgttcccgtttaccccccgtaccccgtttccccttaccggtacccgtacccggggtttaaacgacccggg

SEQ ID NO: 347994 - DNA, 583 bp, Homo sapiens
  misc_feature: GZ8MTXP02IW03A.15.86.H09.1.454.CMB.2.raw
  modified_base (416)..(416): a, c, t, g, unknown or other
  misc_feature (416)..(416): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacagggacgtcccccagtatataatagaaagttaagagtgatggcagccacaccgaaggggacggactccccgatcgcttcagtgggctcctagttcgtggggctcgaccgctacctccaccactctacccaacctccacgtctgacgatgagctagagtatccaatggtggagagagcccaanacaagttagagtcggaccaaaggtacggggtttgggtcgttcggggacggaagggaccaaggctaggacccgtacgtaggtacacggacccaaaggggccctaccggtccccctcggtactcccgtcttccgtccccctacctccctcgtaccgttacgacgtaccg

SEQ ID NO: 347995 - DNA, 629 bp, Homo sapiens
  misc_feature: GZ8MTXP02GBRC8.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacacggaaggggacggatccccgatcgcttcagtggcttccgtaggtttcggggcttcggaccgtcctacctcaccccactccacctaaccctccacgtctgacgatgagctagatatcacgtggtaggaagagacgacaacataatcgagtggacccgaagggtcgggttgggtacgtcggggaacgggtacgggaacccaagcgtaggacccgtcgtaagggtccaaccggaccgacggggcccttccgggccccccgttcgggtaccctaccggttcccttacccggtaacccccctacccgtttcccgaccgtaccgtaaccgggtaacgcccgttacggggg

SEQ ID NO: 347996 - DNA, 594 bp, Homo sapiens
  misc_feature: GZ8MTXP02FNM4T.15.86.H09.1.454.CMB.2.raw
  modified_base (374)..(374): a, c, t, g, unknown or other
  misc_feature (374)..(374): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacaccgaagggggacggactccccgatcgcttcatgggctccagtcgtggggctgaccgctacctcccaccatctacccacctccagtcngacgatgagctgagtatcacgtggtggagagacgcccaacaactaattaggatacgggaccctaaaggggtccggggtttaggggtcggttaccggggacggggaacgggaccaaggcgttacggacccgtcgtagggtccacgccccgaaggcctccgcccccgtcggaccaccgtcctaaccgttcccccaccctcctcggtcctacggtacgtaccg

SEQ ID NO: 347997 - DNA, 633 bp, Homo sapiens
  misc_feature: GZ8MTXP02IGK8U.15.86.H09.1.454.CMB.2.raw
  modified_base (306)..(306): a, c, t, g, unknown or other
  misc_feature (306)..(306): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcacgcccccgtctgcatctgccttgctgggagcctcgatcaagctcacctgcacctaagtagtgagcatacgaacctacaccatcgaatggtatacaacagagacgaggaactccccagtatataatagaaagttagagtgagtgacacgaccacgaaccggaagggggacggacncccgatcgctacgagtcggctcgtagttcggtgggctacgaccgtctacctcccaccactcctaccaacctccagtctagaacgagtagacggtcagtagtactacgacgtaggtaggaggagacgaccaacaactaagttagagtacggacgtaacggtacggggtttaggggttacgggttacggggacgggacgggtttttacgaacgtacgtacggtaccgtacgtacggtacgacgaccggacggaccgtccgcccgtccgtaccgtacctccgttaacccgttccccgtacccgtcccgtaccgtacgtacgtacgtacgg

SEQ ID NO: 347998 - DNA, 636 bp, Homo sapiens
  misc_feature: GZ8MTXP02GXDNU.15.86.H09.1.454.CMB.2.raw
  modified_base (301)..(301): a, c, t, g, unknown or other
  misc_feature (301)..(301): n is a, c, g, or t
  modified_base (429)..(429): a, c, t, g, unknown or other
  misc_feature (429)..(429): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacgganccccgatcgctcatgggctcagttcgtgggctcgaccgctacctcccaccactcctacccaacctccacgtctagaacgactagacggcgtgagtactctaacgtggtagggacgaggacgacccaanaaactaagttacgaagttacgggacccgtaaagggtacggggtttggggtcgggttcggggacggtaacggggaccaaaggtcgtacgaacccggttcgtaaggtcccgaacggtacccgaacggtccgtacccgcccccggttcggtaccctaccgttcccgtccgttcccccggtccctccgtccgtaccgtacgtaacgtccgg

SEQ ID NO: 347999 - DNA, 656 bp, Homo sapiens
  misc_feature: GZ8MTXP02H4GRV.15.86.H09.1.454.CMB.2.raw
  modified_base (342)..(342): a, c, t, g, unknown or other
  misc_feature (342)..(342): n is a, c, g, or t
  modified_base (654)..(654): a, c, t, g, unknown or other
  misc_feature (654)..(654): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgagtggcacgaccacgaaccggaagggggaccggactccccgatcgctcgagtcggctccgtagttcgnggggctcgaccgtcctacctcccacctactcctaccaacctccacgtctagaacgatgagcgtagatactcgagttggagggaagacgtacgaccaaacgtaacgtaagttgaacgtacggggaaccttaaagggggtcgggtttggggtcgggtacggggacggggaagggaacccgtacgttaccgttacccgtaccgtaagggtccaaccggtacccgaaacgggtcctacccgccccccgtggttacccaccgttccgttcccgttcccccgaccctccgttccgaccgtttaccggacgttaccggngg

SEQ ID NO: 348000 - DNA, 644 bp, Homo sapiens
  misc_feature: GZ8MTXP02JGYA9.15.86.H09.1.454.CMB.2.raw
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtggggttggacgtttacaaaagtaaaatgatggtagaagaaatagactacggtgcacccgtgaaaggagattcacatctacaagagaataattacaaaaacgacgtagtattgacaaatgaacagacctagaaccgagacacagcctatatactacgtaccacagattacggaagtgacagtaccggaacgtaaaagggcggtactatggttactttttgaattacgtccgtacgggggaccccgaaggggacctaagtcggttccggtcgtcttccttcacggtccctacccgaccgtaaccgggcccctaacgttcccggtaacccttcccccgtggacccctaccccgtcctacccgaacgcccg

SEQ ID NO: 348001 - DNA, 675 bp, Homo sapiens
  misc_feature: GZ8MTXP02H89B2.15.86.H09.1.454.CMB.2.raw
  modified_base (400)..(400): a, c, t, g, unknown or other
  misc_feature (400)..(400): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccaggaacgtcccccagtatataatagaaagttaagagtgaatggcacgaccaacgaaccggaaggggggaccggactcccccgagtccgctttcgagtcgggctccgagttcggtgggctgaccgacctacctccacctactcctaccacctccagtctagaacgntgagtcgtagagtactcgaacgtggtaggaaggacgaacgtacccaaagactaaagtttcgaagttacggaacccgtaaagggggtacggggtttggggtaggttccggggacgggaacgggaacccagggtaccgtcggtaacccggtcgtaacggggtcccaggacccccggtaaaggggtcccctacccggcccccttacggggtcctaaccccgttcggttaaccccgtccccctaacccgtccctcggaccttacggtacggtaacccgg

SEQ ID NO: 348002 - DNA, 617 bp, Homo sapiens
  misc_feature: GZ8MTXP02H2EGT.15.86.H09.1.454.CMB.2.raw
  modified_base (363)..(363): a, c, t, g, unknown or other
  misc_feature (363)..(363): n is a, c, g, or t
  modified_base (417)..(417): a, c, t, g, unknown or other
  misc_feature (417)..(417): n is a, c, g, or t
  modified_base (479)..(479): a, c, t, g, unknown or other
  misc_feature (479)..(479): n is a, c, g, or t
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttggtccgccaggctcgagggagggctggagtgggtgacgtttacaaaagtaaaatgatggtagaagaaatagactacggtgccacccggtagaaaggaagattcaacccatctacaaganattaaatacaaaaacgcgtagtactttgacaaatgaaacagacctagaaaccgnggaacacgagacccgtactattactgtaaccacagtatcggaagtgacagtcgaacgtaagnggactatgtcttttagatagtcgtcggggccagggacaagttggtcgtcgtctcttacaccgccctaccaaaccgacgggcccctaagtcccggtccctttccccccgagcccctaccccctcgtacccgaaagcccg

SEQ ID NO: 348003 - DNA, 730 bp, Homo sapiens
  misc_feature: GZ8MTXP02FW94W.15.86.H09.1.454.CMB.2.raw
  modified_base (224)..(224): a, c, t, g, unknown or other
  misc_feature (224)..(224): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttcctgctgctatacttaaaaggtgtccagtgtgaagtgcgaggtggtggagtcgtggggganccgttggtaaacggccgtggggggtcccttaggacgttcctccgtgtggtggcctctggattctactttcagtaatggctggatggtaggtcgggtcccgccgaggcctaccgggaggggaaggggtcgtgggaggttggggttaggtaacgtttaacgaaaaaggttaaaaatggagtagggtagaaacgtaaaaagtacgaacgtacggtcgaccgaaccggtaggaaaagggaacgtattacccgaactatacctagaaaagaagtaaattaaacgtaaaacgaaaaacggtaggtttaagtatttagaaactaaatacgaaactacgacccgtaaaggaaaaccccgaggaaccaacgacgtacccgttacttaaattaccgttaacgaacctaaacgacgttaacgttaacgggaagttacgacctaaacggtaaccggaaacggttaaaaggccgtataacgttgtacgttttagactacggttcgggaccgggtaaccg

SEQ ID NO: 348004 - DNA, 686 bp, Homo sapiens
  misc_feature: GZ8MTXP02JU0DB.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccgaggaacgtcccccagtatataatagaaagttaagagtgagtggcagccacaccgaagggggacggacgccccgatcgcttcgatgggcctacgtagttcgtggggctacgaccgcctacctccccacctactcctaccctaacctccagtccgtagacggagttgacggtctgaagtaactcgaaaccgttgggagggaacggaacggtacgaccccctaaaactaaacgtaagttacggaacgtaccggggaaaccgttaaagggggttcggggtttggggtacgggttaccgggggaacggggaaccgggaaccgtaacgtccggtacggtacccgttacgtagacccgacggacccgtacggcccctacccggtccccgtacgtccctacccgttccgtccccgttcccccgtacccctacggtaccgtaccgttaacggacgtcgg

SEQ ID NO: 348005 - DNA, 651 bp, Homo sapiens
  misc_feature: GZ8MTXP02FRE44.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatccgaacctacaccatcgaatggtatcaaacagacgaccgagggaacgtcccccagtatataatagaaagtaagagtgatggcagaccaacgaccggaagggggacggactaccccggatccgtctcgagtcgggtctccgtaggttcgtcggggtcctcgacccgtacctaccctcccacccctactccctaccctaaccctcctaacgtccgtacgacggtagtcggaggacgtagtacgtactccgaacgttggagggaagaggacaccaaacgactaagttagagttacgggaaccgtaaagggtcggggttgggtcggtacggggagggaacgggacgaagtcgtacgacccgtacgtacggccacgccgagccgtcccgccccgtcgtacctccgttcccttcccggtaccccctacccgtccctacgtccgtacggtacgtaccgg

SEQ ID NO: 348006 - DNA, 602 bp, Homo sapiens
  misc_feature: GZ8MTXP02GOSD9.15.86.H09.1.454.CMB.2.raw
  modified_base (349)..(349): a, c, t, g, unknown or other
  misc_feature (349)..(349): n is a, c, g, or t
  modified_base (356)..(356): a, c, t, g, unknown or other
  misc_feature (356)..(356): n is a, c, g, or t
  modified_base (422)..(422): a, c, t, g, unknown or other
  misc_feature (422)..(422): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccaacgaccgaagggggaccggatccccgatcgcttcagtggctcgagtcgtgggctcgaccgctacncccaccnctcaccacctccgagtctagacgagtcgaggctgagtactcacgttggaggagaagacgacccaanaactaaagttgaagtcggaccaaagggtcgggtttagggggtcgttacggggacggaacgggtaaccgaggccgtcggacccgtccgttaggccaacggccccaaagggtccctaccggcccccgtacggtccaccgttctaacccgtcccccgaccctccgcgtacgtacgtacgacgg

SEQ ID NO: 348007 - DNA, 743 bp, Homo sapiens
  misc_feature: GZ8MTXP02JUAAW.15.86.H09.1.454.CMB.2.raw
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgaggggaggggcgtggaggtggggttggtacgtttacaaaagtaaaatgatggtagaagaaaatagactacggtgcacccgagaaaggaagattcacatctacaagagaataattacaaaaacgtcggtagtatttagactaaatagaacagacctaagaaaccgagaacacgacgccgttactacttacctacgtaacccaacgtagaacgtttacgggaaagttcgacaagtaccggaaaggtaaaaggagggtactaagttcgttacgttttagaatttacgttaccggtcgggggaccccctaaggggtaacctaaaggttcgggttccgttccggttcctttccgttaccgtaccggtaccccctacccgaacccggaacccgggtaccccctaccgtttccccggttcccccgttcccccccgtacgggtaccccctacccccggttaccccttaccccgaaaacggtcccccgg

SEQ ID NO: 348008 - DNA, 669 bp, Homo sapiens
  misc_feature: GZ8MTXP02IXZ0V.15.86.H09.1.454.CMB.2.raw
  modified_base (345)..(345): a, c, t, g, unknown or other
  misc_feature (345)..(345): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccagtatataatagaaagttaagagtgatgcacgccacgaccgaaggggacggactcccgatcgctcagtggctcagttcgtgggctcgaccgctaccnccaccactctacctacctccacgtctacgacgagtgacggtctagagttactcacgtgggtaggaagaacggacgccccaaataacgtaagttaggacgttacggggaacccgtaaaggggtaccgggggttttggggtacgggttaccgggggaccgggaaacggggacccgtaaggtccgttaacgggaccccgttacgtacgggtacccgaaccggcccgtaaacgggggtccctacccggtccccccggttcgggtaccctacccggtttcctaacccggttccccccaccgttccccgtacggtaccgtacgtacgtcg

SEQ ID NO: 348009 - DNA, 669 bp, Homo sapiens
  misc_feature: GZ8MTXP02JSQHD.15.86.H09.1.454.CMB.2.raw
  modified_base (306)..(306): a, c, t, g, unknown or other
  misc_feature (306)..(306): n is a, c, g, or t
  modified_base (488)..(488): a, c, t, g, unknown or other
  misc_feature (488)..(488): n is a, c, g, or t
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggtctggaggtgggtggacgtttacaaaaaggtaaaangagtggtagaaagaaaatagactaggtgcaccgtagaaaggatatacaccatctacaagataataacttaaacgaaaaacgtcggtattattacgaactaaagtacgaacacgtaccgtaacgaaaccggacggaaacctaacgacgtccgttaccttaattaaaccgttacgtaacccaanaaagttacgttacgggaaatcgaccagttacggaaacgtaaaaggggcgtatagttgttcgtttagattcgtcgggaccggaccgaaggactagttcggtactcgtcttcacgacctccaccgaacgaccggacctcgtcccgtcccctcccgtaccggccctaccctaccgacgacgccg

SEQ ID NO: 348010 - DNA, 638 bp, Homo sapiens
  misc_feature: GZ8MTXP02GDD5U.15.86.H09.1.454.CMB.2.raw
  modified_base (299)..(299): a, c, t, g, unknown or other
  misc_feature (299)..(299): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttggtccgcaggctcgagggagggctggagtgggtggacgttacaaaagtaaaangatggtagaagaaaatagactacggtgaccaccgtagaaaggagatcacatctacaagagaataattaacgaaaaacgacggtagttatttacgactaaatgaaacagacctaagaaccgagacacacgcctactatactgtaccacagagttagaagtgactagacgaaacgtaaaggacgtacttagtcgttacttttagacttagtccggtcggggacccgaagggtaactaaggtcggtcgtcttaccgttctcgacgtccctaccgaccgtaaaccgggccctagttcccgtaacccgttcccccgtggcccctacccctcctaccgaacgccg

SEQ ID NO: 348011 - DNA, 588 bp, Homo sapiens
  misc_feature: GZ8MTXP02GAWN5.15.86.H09.1.454.CMB.2.raw
  modified_base (435)..(435): a, c, t, g, unknown or other
  misc_feature (435)..(435): n is a, c, g, or t
  modified_base (455)..(455): a, c, t, g, unknown or other
  misc_feature (455)..(455): n is a, c, g, or t
  modified_base (470)..(470): a, c, t, g, unknown or other
  misc_feature (470)..(470): n is a, c, g, or t
  modified_base (567)..(567): a, c, t, g, unknown or other
  misc_feature (567)..(567): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtggggttggacgtttacaaaagtaaaatgatggtagaagaaatagactacggtgcaccgtagaaagagatcacatctacaagagataattacaaaacgacggtagtattagacaaatagaacagacctagaaccgagacacacgccgtactattacngtaccacagattcggaagtncatcgaacgtaaagngtactatgtctttagatagtcgtcggggaccagggacagtggtcgtcgtctctcacgccctaccgaccacgggccctagtcccgtccgttcccccgngcccaccctcctcaacgtccg

SEQ ID NO: 348012 - DNA, 568 bp, Homo sapiens
  misc_feature: GZ8MTXP02I4DC5.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagacaacaccgaaggggacggatccccgatcgcttcatgggctcagttcgtggggctgaccgctacctccaccactctaccaacctccagtctgacgatgaggctgatatcactggaggagagacgccaacacaattgatgggaccaaaggtcgggtttagggtgttcggggacgggaacgggacccaaggcgtaggacccgtcgtagggcacggcccaagggcctacgccccgtcggtaccaccgtcttcccgttccccaccgttccctacgtcctaacggtacgaccg

SEQ ID NO: 348013 - DNA, 600 bp, Homo sapiens
  misc_feature: GZ8MTXP02IZXYR.15.86.H09.1.454.CMB.2.raw
  modified_base (420)..(420): a, c, t, g, unknown or other
  misc_feature (420)..(420): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacaccgaagggggacggatccccgatcgcttcatgggctccagttcgtgggctgaccgctacctccaccatctccaacctccacgtctgacgatgaggctgacgtatcgaacgtgtagggaagagacgccccaaanaactaagtgacgtacggaccgtaagggtacggggtttgggtcggttcgggacgggacggaccgaacggcgtacggaccgtacgtacggtccacggacccgacggccgtcccgccccgtcgtacctaccgttaccgttcccgttaccccctaccgttcccgtccgtaccgtacgtacgtcg

SEQ ID NO: 348014 - DNA, 544 bp, Homo sapiens
  misc_feature: GZ8MTXP02H2HTT.15.86.H09.1.454.CMB.2.raw
  modified_base (399)..(399): a, c, t, g, unknown or other
  misc_feature (399)..(399): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaaggggacggatccccgatcgctcatggctcagttctggggctgaccgctacctcaccatctccaactccagtctgacgatgagctgagtatcactgtggagagagccctaanaactatgatcggaccgtaaggtcgggtttggtacggtcgggacggaggaaccgagtcgtacggaccgtcgaggtcacgacccgaggcctccggcccctggtactaccgtccgtccgtcccccacctccgcgtacctacgtacgcg

SEQ ID NO: 348015 - DNA, 634 bp, Homo sapiens
  misc_feature: GZ8MTXP02J02JE.15.86.H09.1.454.CMB.2.raw
  modified_base (605)..(605): a, c, t, g, unknown or other
  misc_feature (605)..(605): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtgggttggacgtttacaaaagtaaaatgatggtagaagaaaatagactacggtgcaccgtagaaagaagattcacatctacaagagataatacaaaaacgtacggtatattcgacaaatagaaacagacctagaaaccgagaacacgagccgtactattacagtaaccacagtacttacggaagtgacagtacgaaacgtaaagaggtactagtgtacttttgattagtcgtcggggaccccgtaagggactaagtcggttcgtcgtacttctacgacgcccctaccaccgtaacggcccctagttcccggtccctttacccccggngcccctacccctcccgtaccaaacggccg

SEQ ID NO: 348016 - DNA, 771 bp, Homo sapiens
  misc_feature: GZ8MTXP02I4AOT.15.86.H09.1.454.CMB.2.raw
  modified_base (253)..(253): a, c, t, g, unknown or other
  misc_feature (253)..(253): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatcttaaaggtgtccagtgtgaagtgcgaggtggtggagtcgtgggggagccgttggtaaagccgtgggggtcccttagngtctctgtgtgctctgattcactttcagtagtggctggatgtaggttcgggtccgccgaggcctccggaggggaacggggcgtaggggaggttggggttacggtaacgtttaacgaaaaagttaaaaagtgtaagtagggtagaaagtaaaagtagtacgtacggtgaccgaaccgtaggaaaagggaataagttaccaacctatactacaaaggaataaacttaaacttaaacgaaaaaacggtcggttaagtttatttaggaactaaaagtacgaaacgaacggtaacccttaaacgggaaaaacccggaggaaaacccaacgtaaccgggtaccccttaaccgtttaaagtttaacccgtaggttacccgaaccccgtaaacgaaggttaacggtttaaccggggtaaagttcgggaaacctaaggtaacccggtaaaacggggtaaaagggaacggtaacctttaaaggtgttttaacgtttaggtaacgtttcgttacgggtaaccccggggg

SEQ ID NO: 348017 - DNA, 596 bp, Homo sapiens
  misc_feature: GZ8MTXP02IJ4CU.15.86.H09.1.454.CMB.2.raw
  modified_base (400)..(400): a, c, t, g, unknown or other
  misc_feature (400)..(400): n is a, c, g, or t
  modified_base (413)..(413): a, c, t, g, unknown or other
  misc_feature (413)..(413): n is a, c, g, or t
  modified_base (568)..(568): a, c, t, g, unknown or other
  misc_feature (568)..(568): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctggggggagccttggtaaagcctggggggtcccttagagtctcctgtgtggcctctggattcactttcagtaatggctggatgagttggccgcaggctcgagggagggctggagtgggtgacgttacaaaagtaaatgatggtagaagaaatagactacggtgcacccgtagaaagagattcacatctacaagagataatacaaaacgcgtatattgacaaatgaacagacctagaaccgngaacacagccgtntatactgtaccacagattcgaagtgacaatcgaacgtaaaggagactatgtcttttagattagtacgtcggggaccagggactaagtcggttacgtcgtacgttctcacgtcctaccgaccgaccgggaccctagtcccggttccttacccccgngtcccctaaccctcctaccgaacgaccg

SEQ ID NO: 348018 - DNA, 659 bp, Homo sapiens
  misc_feature: GZ8MTXP02G0CQ4.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatacgaacctacaccatacgaatggtatacaacagaagaccgaggaacgtccccagtataataatagaaagtaagagtgagtggcacgaccaacgaacggaaggggaccggactacccgatcgctacgacgtcggctccgtaggttccgtggggtcgtacgacccgacctacctcccacctactaccctaccaaccctaccgacgtccgtagaacgtgaggagggtctaggtaacgttactaccgtagtggaacggagaacgaccgtaccaacgtaacaagttagacggttaggaccgtaagggtacggggttggggtacggtcggggacggtacggaacaggtcgtacggtaccggtacgtacggaccgaccacccggaaggtcccctacccgtccccggtacgttacccacgttccctccggttccccctccgtcgtaccgaccgttacgacgtaccgg

SEQ ID NO: 348019 - DNA, 644 bp, Homo sapiens
  misc_feature: GZ8MTXP02JZ5S1.15.86.H09.1.454.CMB.2.raw
  modified_base (372)..(372): a, c, t, g, unknown or other
  misc_feature (372)..(372): n is a, c, g, or t
  modified_base (451)..(451): a, c, t, g, unknown or other
  misc_feature (451)..(451): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgaggggaaggggctggagtggggttggacgtttacaaaagtaaaatgatggtagaagaaaatagaacgtacggtgccacccgtagaaaggaagattcaccatctacaaganataatacaaaaacgcgtagtattgacaaatgaacagacctaagaaccgagaacacgacgccgtactattacagtaccanagtagttcggaatgacactacggaacggtaaaggacgtacttaagtggttactttagattacgtcggtacggggcccaaggggtactaagttcgggtacgttcgtcttcttacgacgccctacccgaaccgaccgggccctacgttcccggtcccttcccccggtgacccctccccgtcctaccaacgtcccg

SEQ ID NO: 348020 - DNA, 643 bp, Homo sapiens
  misc_feature: GZ8MTXP02H6PIP.15.86.H09.1.454.CMB.2.raw
  modified_base (435)..(435): a, c, t, g, unknown or other
  misc_feature (435)..(435): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatacaacagagaccgaggaacgtcccccagtatataatagaaagttaagagtgatggacagaccacgaccggaagggggacggactccccgagtcgctcgagtcggctcgagttcgtgggctgaccgctacctccacctactcctacccaacctccgagtcgtagacgagtgaggctagagtactccagttggagggaagagaacgccctaaanaacgtaaagttgaacgtacgggaacctaaaggggtcggggtttggggtcggtacggggacgggaacggggacaaggtcgtacgacccgtagtaacggtaccacggacccgaagggcctacccggtcccccgttcggcccttaccgttcccgttcccggttaaccccctacccgttcccgtaccggtaccgttaacggtaacgaccggg

SEQ ID NO: 348021 - DNA, 762 bp, Homo sapiens
  misc_feature: GZ8MTXP02GCPBR.15.86.H09.1.454.CMB.2.raw
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatacaacagagaccgaggaacgtccccagtatataatagtaaagttaagagtgagtggacacgaccacgacggaaggggacggactcccgatcgctcagtggctcagttcgtggggtctcgaccgcctaccncccaaccnctacctaccctaacctacctacgtccgtacgacgtagtacggacgtcgtagggtaactataccgtaagttggggtaagggaacggaaggaacccgaccctaaacgaaacgttaagttacggacgtacggggtaaaccgtaaagggggtttacccgggggtttgggggttaccgggtttaccgggggaaccggggtaaccgggaaccgtaacgggtcccgttaacgggtaccccggtacgttacgggtacccgaaaccgggaccccgtaaacgggtcccgttaaccccgggttccccccgttaagggttacccctacccggtttaccccttcccccggttaaccccccgttaaccccttcccgggttaacccgtaccgtttaaccggtacgtaacccgggg

SEQ ID NO: 348022 - DNA, 622 bp, Homo sapiens
  misc_feature: GZ8MTXP02FK2RZ.15.86.H09.1.454.CMB.2.raw
  modified_base (342)..(342): a, c, t, g, unknown or other
  misc_feature (342)..(342): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccgttggtaaagccgtggggggtcccttaggagtctcctgtgtggcctctggattcactttcagtatggctggatgagttggtccgcaggctcgagggaggctggagtgggtgacgttanaaaagtaaaatgagtggtagaagaaaatgaactacggtgaccgaccgtgaaaaggagtattaccacatctacaaagagaataataacgaaaaacgtcgttagtattagacaaatagaacacggaccaagaaaacccgaggaaccacgagtaccccgtataactttacacgtaaccaacgtaggtaacgttacggaaagtcgacgtaaagttaccgaaaacgttaaaacggagtacgttaatcgtacgttttagattttaggccgtacgggggtaaccccg

SEQ ID NO: 348023 - DNA, 565 bp, Homo sapiens
  misc_feature: GZ8MTXP02INT9V.15.86.H09.1.454.CMB.2.raw
  modified_base (405)..(405): a, c, t, g, unknown or other
  misc_feature (405)..(405): n is a, c, g, or t
  modified_base (420)..(420): a, c, t, g, unknown or other
  misc_feature (420)..(420): n is a, c, g, or t
  modified_base (551)..(551): a, c, t, g, unknown or other
  misc_feature (551)..(551): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatggtatcaacagagaccgagggaacgtcccccagtatataatagaaagttaagagtgataggcagccaacgacgaaggggacggactccccgatcgcttcagtcggctccgtagttcgtggggctgaccgcctacctcccacctatcctccaacctccagtctgacgatgagctagatatcacgtgnggagagacgcccaanactaaagttgatacggacaaaggtcgggttggtgtcgggacggagggaccagctacgaccgtcgagtccacgaccccagggcctaccgcccccgtcggtccaccttcgtcccgttcccccgcctcccgtcnccgttacgacgacg

SEQ ID NO: 348024 - DNA, 596 bp, Homo sapiens
  misc_feature: GZ8MTXP02GDQC9.15.86.H09.1.454.CMB.2.raw
  modified_base (326)..(326): a, c, t, g, unknown or other
  misc_feature (326)..(326): n is a, c, g, or t
  modified_base (418)..(418): a, c, t, g, unknown or other
  misc_feature (418)..(418): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccaggacgtccccagtatataatagaaagttaagagtgatggcagccacgacgaaggggacggactcccgatcgctcatgggctcgagttcgnggggctgaccgctacctcccaccatcctaccaacctccacgtctagacgatgacggtctagagtactcaacgtggtaggagagacgcccaanaacgtaattaggaatcggggaccaaagggtcggggtttggggtacgttcgggggacggaaggggacctaaggctacggacccgtcgtaggccacggcccctaaagggccctaccggcccccttaggccaccgtttccgccgttccccccaccttccgaccgtactaaccgtagtaccg

SEQ ID NO: 348025 - DNA, 681 bp, Homo sapiens
  misc_feature: GZ8MTXP02GOEEH.15.86.H09.1.454.CMB.2.raw
  modified_base (304)..(304): a, c, t, g, unknown or other
  misc_feature (304)..(304): n is a, c, g, or t
  modified_base (340)..(340): a, c, t, g, unknown or other
  misc_feature (340)..(340): n is a, c, g, or t
  modified_base (480)..(480): a, c, t, g, unknown or other
  misc_feature (480)..(480): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatacaacagagaccaggacgtccccagtatataatagaaagttagagtgagtggcagccaacgaccggaagggggacggacnccccgatccgcttcagtcgggcctccgtaggttcgnggggtcctcggacccgcctacctaccccacccctaacttccctaccccaaccctacccgtaacgtcctacggaacgtaagttcgggaacggtcgtagtaacgttactaccgtacgtgggtagggaagaaggacgcccaanactaagttacgactacggggaccgtaaagggttcgggggtttcgggggtacggttccgggggacgggaaacgggaccaaacgggtcttaacggaccccggttacgtaaggggcccacgggaccccgtaaggtcccgtcccgacccccgtcgtaacctcttcccgtccggtccccacccgtcctccggactacgtacgacgg

SEQ ID NO: 348026 - DNA, 608 bp, Homo sapiens
  misc_feature: GZ8MTXP02I1LSB.15.86.H09.1.454.CMB.2.raw
  modified_base (332)..(332): a, c, t, g, unknown or other
  misc_feature (332)..(332): n is a, c, g, or t
  modified_base (415)..(415): a, c, t, g, unknown or other
  misc_feature (415)..(415): n is a, c, g, or t
  modified_base (587)..(587): a, c, t, g, unknown or other
  misc_feature (587)..(587): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcaccctgcaccctaagtagtgagcatcgaacctacaccatcgaatggtatcaacagagaccaggggaacgtcccccagtatataatagaaagttaagagtgatggcagccacaccgaaggggacggatccccgatcgcttcatgggctccagttcgnggggctgaccgctacctccaccatctccaacctcccagtctgacgatgaggctagagttatcactggtaggagagagcccaanacaaagttgattcggaccgtaaaggtaccggggtttggggtacggtttcgggacgggaacggggacccaaggtcgtacgggacccgtaccgtagggtccaacggccccgaaaggccttccggccccccgttacgggtcctaccttcgttccgttcccccaaccccgtttccncggtactaccggttacgaccg

SEQ ID NO: 348027 - DNA, 700 bp, Homo sapiens
  misc_feature: GZ8MTXP02I3T1M.15.86.H09.1.454.CMB.2.raw
  modified_base (303)..(303): a, c, t, g, unknown or other
  misc_feature (303)..(303): n is a, c, g, or t
  modified_base (353)..(353): a, c, t, g, unknown or other
  misc_feature (353)..(353): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatacaacagagacagggaacgtccccagtatataatagaaagttaagagtgatggcagccacgaccggaaggggacggacnccccgatcgcttcagtcgggctcgtagttcgtggggctcgaccgctaccncccaccactcctaccacctccacgtctagacgagtgaggtctagacgtatccacggttgagggaagagacacccaaacgataaagttggaacgttcgggaacccgtaaaaggggtaccgggggttttgggggtaccgggtttaccggggggacggggaacggggaacccgaaacggtcggtaccggaacccggttacccgtagggggcccaacgggtcccccggaaaggggtcccctacccggtccccccgttaggggtacccttaccgttacccggttcccccgttacccccggtacccccttccggtaccccggtacctttaaacccgggtaacgttcccggggg

SEQ ID NO: 348028 - DNA, 714 bp, Homo sapiens
  misc_feature: GZ8MTXP02IN74A.15.86.H09.1.454.CMB.2.raw
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgaggggaaggggctgggagtggggttggacgtttacaaaagtaaaatgatggtagaagaaaatagactacggtgacacccgtagaaaggagatcaccatctacaagagataaattacaaaaacgtacggtagtatttacgacaaatagaacagtacctaacgaaaccgaggaacacgacgtacccgtctaacttactacgtaaccaacagtacgttacggaagtacgacagtacgaaacggtaaaggaggtacttaagtgttacgtttttagaattacgtacggtcgggggacccgaagggggtaacctaaaggttcgggttacccgttacgttcctttccgtttacccgacggtcccctacccgaacccgaaaccggggtaccccctaaggttcccccgggttcccttttccccccgcggtccccctaccccgtcccgtaccgaacgacccg

SEQ ID NO: 348029 - DNA, 591 bp, Homo sapiens
  misc_feature: GZ8MTXP02GELRR.15.86.H09.1.454.CMB.2.raw
  modified_base (406)..(406): a, c, t, g, unknown or other
  misc_feature (406)..(406): n is a, c, g, or t
  modified_base (410)..(410): a, c, t, g, unknown or other
  misc_feature (410)..(410): n is a, c, g, or t
  modified_base (419)..(419): a, c, t, g, unknown or other
  misc_feature (419)..(419): n is a, c, g, or t
  modified_base (427)..(427): a, c, t, g, unknown or other
  misc_feature (427)..(427): n is a, c, g, or t
  modified_base (447)..(447): a, c, t, g, unknown or other
  misc_feature (447)..(447): n is a, c, g, or t
  modified_base (456)..(456): a, c, t, g, unknown or other
  misc_feature (456)..(456): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatacaacagagaccgagggaacgtccccccagtatataatagaaagttaagagtgatggcagccacacgaaggggacggactccccgatcgcttcagtcgggctccgaggttcgtcggggctcgaccgacctacctccaccatcctacccaacctccagtctagacgatgagctgatatcatgngganagacgccanacaatgancggacaaggtcgggttgggngttccgggnggacgggaccaggcgtacgacccgtacgtacgggtcacggacccgaaggcccgttcccgcccccgttcggtaccctccgttccgttaacccgtttcccccaccccttccggtaccgacccgttacgtacgaccgg

SEQ ID NO: 348030 - DNA, 721 bp, Homo sapiens
  misc_feature: GZ8MTXP02GT4EQ.15.86.H09.1.454.CMB.2.raw
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctggggggagccttggtaaagccgtggggggtcccttagagtctcctgtgtggcctctggattcactttcagtaatggctggatgagttgggtccgccaggctccgagggagggctggagtgggtggacgttacaaaagtaaaatgatggtagaagaaaatagactacggtgaccgaccgtagaaaggaagattcaccatctacaagagaataaacttaacaaaaacgtcggtagttattacgactaaatagaaacagacctaagaaaccggagaaccaacgacgtccgtacttaacttactacgtaacccaacgaagtacgttacggaagtgacgtaacgtacggaaacggtaaaagggacggtactaagttcgtacgtttttagaactttacgtccggtccgggggacccgtaagggggtaacctaaaggttcgggtacgttccggttcttccgttacgaccgtccctacccggaaccgaccggggtacccctacggttcccggttccccgttcccccgtcggtaccccctaccccgttacccgtaccgaaaccggtcccg

SEQ ID NO: 348031 - DNA, 733 bp, Homo sapiens
  misc_feature: GZ8MTXP02G5XRK.15.86.H09.1.454.CMB.2.raw
  modified_base (297)..(297): a, c, t, g, unknown or other
  misc_feature (297)..(297): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccaggaacgtcccccagtatataatgaaagttaagagtgatggcagccacacgaaggggacgganccccgatcgcttcatgggctccagttcgtgggctgaccgctacctccaccactcctaccaacctccagtcctagacgtatcggaacgcgtagtaagttactcgtaccgttaggtacgggaagaagaacgaccctaaacaactaaagtttgaacgttacgggaacccgaaaagggttaccgggggtttgggggtttcggttaccgggggaccggggtaaacgggggaacccgaaaagggtcccgttaacgggtaaccccccggttacggttaaaacggggtccctaaaccggggaccccccgaaaaggggtccccgtaacccggtaccccccccccggtttgggttaccctaacccttttccccgttcccggtttaaaccccccaccccccgttttcgtaccccgtacccggtttaaaccggtaaacggttacccgg

SEQ ID NO: 348032 - DNA, 619 bp, Homo sapiens
  misc_feature: GZ8MTXP02HRK2B.15.86.H09.1.454.CMB.2.raw
  modified_base (304)..(304): a, c, t, g, unknown or other
  misc_feature (304)..(304): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaccggaaggggacggacnccccgatcgctcagtggctcgagttcggtggggctcgaccgtctacctcccacctactcctacccaaccttcccagtcctacgacgtagtggacggcgtagtacgtatcacgttggaggagagacgccaatacaagttgagtcggaccgtaaggtacggggtttgggtacggttcgggacgggtaacggacgaagccgtacggacccgtacgtacggtccgacggcccgaaacggtcccgtcccggcccccgttcggtacctcccttccgttcccgtcccccgtccctttcccgccgtaccgttacgtacgtcgg

SEQ ID NO: 348033 - DNA, 726 bp, Homo sapiens
  misc_feature: GZ8MTXP02FO53P.15.86.H09.1.454.CMB.2.raw
  modified_base (292)..(292): a, c, t, g, unknown or other
  misc_feature (292)..(292): n is a, c, g, or t
  modified_base (329)..(329): a, c, t, g, unknown or other
  misc_feature (329)..(329): n is a, c, g, or t
  modified_base (513)..(513): a, c, t, g, unknown or other
  misc_feature (513)..(513): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggagggctggagtgggttggacgtttanaaaagtaaaatgatggtagaagaaaatgactacggtnacgaccgtagaaaggagatcacatctacaagagaataaattacgaaaaacgtcggtagttatttgacaaatcgaaactacgaccgtaagaaacccgaggaaccaacgacgtcccgtataacttactacgtaaccacgtagaacttacgggaagtcgctaaacgtacggaaacggttaaaagggnggtacttaaagttggttactttttagaacgtttaagtccgggttacgggggacccgaaggggtaactaaacggttcggggttccgttacggttcctttccgttaccgaaccgtttccccctaacccgaacccgaacccggggtacccctacggttcccggttccccttcccccgtcggaccccctaacccgtcccctaacccgaaggtacccg

SEQ ID NO: 348034 - DNA, 678 bp, Homo sapiens
  misc_feature: GZ8MTXP02JPTAJ.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcataccgaacctacaccatacgaatggtatacaacagacgaccgacggaacgtccccaagtatataatagaaagttaagagtgatgcacgccacgaaccggaaggggacggactcccgatcgtctcgagtcggctcgtaggttcggtgggctcgaccgctacctacccacctactccctaccctaccctccgacgtctagacgtagtggagtctagtagtactcgacgttggacgggagaaccggacaaccctaacgtaacgtaagttacggacgtacggggaacccggtaaaggggttacgggggtttgggggttacgggttacgggggaacgggaacggaccggtaagccggttacggaccccgttacgtacgggaccgtaccggaccccgtaaacggcccgtcccgtaccccgtacggtccctaccgttcccgtccgttccccctacccgttccgtaccgacgtttaacggaccgacgg

SEQ ID NO: 348035 - DNA, 684 bp, Homo sapiens
  misc_feature: GZ8MTXP02IYDM3.15.86.H09.1.454.CMB.2.raw
  modified_base (332)..(332): a, c, t, g, unknown or other
  misc_feature (332)..(332): n is a, c, g, or t
  modified_base (356)..(356): a, c, t, g, unknown or other
  misc_feature (356)..(356): n is a, c, g, or t
  modified_base (501)..(501): a, c, t, g, unknown or other
  misc_feature (501)..(501): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaagggctggaggtgggttggacgtttacgaaaaagtaaatgatggtagaagaaatagactacggtncacccgtagaaaggagatcaccanctacaagagataattacaaaacgtacggtatattcgacaaatgaaacacgaccaagaaaccgaggaacaacgacgaccgttactacttactacgtacccaacgagtacgttacggaagtcgactacgtacgaaacggtaaagggngtactagtgttctttagattgtcgtcggggaccaagggtacctaggtcggttacgtcgttctccgttacaccgtccccgtaccgacccgaaaccggggccccctaacggtttcccccggtcccccgttccccccggttaccggacccccttaccccctaccgtacccccgaaaggtaccccgg

SEQ ID NO: 348036 - DNA, 607 bp, Homo sapiens
  misc_feature: GZ8MTXP02HU6HR.15.86.H09.1.454.CMB.2.raw
  modified_base (301)..(301): a, c, t, g, unknown or other
  misc_feature (301)..(301): n is a, c, g, or t
  modified_base (419)..(419): a, c, t, g, unknown or other
  misc_feature (419)..(419): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacgganccccgatcgcttcagtggctccagttcgtgggctgaccgctacctccaccactcctacccacctcccagtctagaccgatgaggtctagagtatcacgttgtaggagagagacccaanacaattgataggaccaaaggtacgggtttggggtaggttcggggacgggtaagggaccaaggcgtacggtacccgtacgtacggtcaacggccccgaaaggcctaccggcccccctcgggtaccctaccgttccgtaacccgttcccccaaccctttcccgaccggtaccttaacggtacgtacccgg

SEQ ID NO: 348037 - DNA, 616 bp, Homo sapiens
  misc_feature: GZ8MTXP02GLZOR.15.86.H09.1.454.CMB.2.raw
  modified_base (437)..(437): a, c, t, g, unknown or other
  misc_feature (437)..(437): n is a, c, g, or t
  modified_base (467)..(467): a, c, t, g, unknown or other
  misc_feature (467)..(467): n is a, c, g, or t
  modified_base (581)..(581): a, c, t, g, unknown or other
  misc_feature (581)..(581): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtggggttggacgtttcaaaagtaaaatgatggtgagaaaatagactacggtgcacccgtgaaaggagattcacatctacaagagataattacaaaaacgacgtagtatttgacaaatgaacagcctagaaccgagacacagccgtctatactgtaccanagattcggaagtgcaatcgaacgtaaaggnggacttatgtctttttgattagtcgacggggtacccaggacaagttcggtcgtcgtctcttacagtccctaccgaccgaacggggcccctagttcccgggtcctttacccccgnggtacccctaccccgtccctacccgaacgtacccg

SEQ ID NO: 348038 - DNA, 752 bp, Homo sapiens
  misc_feature: GZ8MTXP02FL4DG.15.86.H09.1.454.CMB.2.raw
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtgggggagccgttggtaaacggccgtggggggttccccttaaggacgttctccgtgtgtggcctcgtggtattcactttcagtaatggctggatgtaggttcgggtccgcgaggctccgaggggaaggggctgggaggtggggttaggacgtttaacaaaaagttaaaaatgaagtaggtagaagaaaatagaactacggtacgaccgaaccggtagaaaagggaagaacgttaccaccaatctacgaaagagtaaactaaattaacgaaaaaacggtcggttagtaactttagaactaaaagtacgaaacgaaacgacctaaaggaaaaacccgaggaaaccaacgtaacgaccccgttaataacttaacctacggtaaaccctaaactagggtaaacctttaggggaaaacgttcggaaacctaacggttaaccggaaaaccggggttaaaaaagggcgggttaacccttaaagtttcggttaactttttacgggaaacttttaaggtcccggggttaccgggggaaaccccgg

SEQ ID NO: 348039 - DNA, 639 bp, Homo sapiens
  misc_feature: GZ8MTXP02HLL24.15.86.H09.1.454.CMB.2.raw
  modified_base (397)..(397): a, c, t, g, unknown or other
  misc_feature (397)..(397): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacaggaacgtccccagtatataatagaaagttagagtgatggcagccacgacggaaggggacggactccccgatcgcttcagtggctcgagttcgtgggctcgaccgtctacctccaccatcctaccaacctccagtcagacgagcgagctggatactcgagtgnggagagacgacctacaactaagttcgagttacgggaccgttaaaggggtccggggtttggggtacggttacgggggacgggtaacggggaaccttaagggccgtacggtacccggttaccgtaggcccgtaaaccggtccccggaaggtcccgtcccggtcccccgttcggtcctaaccgttcccgttcccggttccccctcccgttaaccccgtcggtacccgtacggttaacgtcccggg

SEQ ID NO: 348040 - DNA, 567 bp, Homo sapiens
  misc_feature: GZ8MTXP02H73DA.15.86.H09.1.454.CMB.2.raw
  modified_base (257)..(257): a, c, t, g, unknown or other
  misc_feature (257)..(257): n is a, c, g, or t
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
  modified_base (408)..(408): a, c, t, g, unknown or other
  misc_feature (408)..(408): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataanagaaagttagagtgatggacagccacaccgaaggggacggatccccgatcgcttcagtgggctccgtagttcgtggggctcgaccgctacctccaccactccaccacctccgatcngacagtgagcngatancacgtgtgagagagccaanacgaatgatggacctaagggtacgggttgggtcgtcggggacgggtaaggaccaaggtctacggtaacccgtcgtacggccgaacgtcccgaaggtccgtaccgccccgtacggtcctacgtccctcgtaccccaccctccgtacgcctacgtacgccg

SEQ ID NO: 348041 - DNA, 632 bp, Homo sapiens
  misc_feature: GZ8MTXP02JNQOY.15.86.H09.1.454.CMB.2.raw
  modified_base (259)..(259): a, c, t, g, unknown or other
  misc_feature (259)..(259): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataanagaaagttaagagtgatggcagccacgaccgaaggggacggatccccgatcgcttcagtgggctcgagttcgtggggctcgaccgctacctccaccactcctacccaacctccagtctacgacgagtgagggctagagtactcaacgtggtaggagagacgcccaaagtaacaagttgacttcggggacctaaaagggttcgggttggggtacggttcgggggacgggtaacgggaaccaaggccgtaggaaccccgtccgtaagggccaacggccccgtaaaggggccctcccggccccccgttgggtacccacccggttcctccggttccccccaacccttccgtacccgtacgttacccggtaagaccgg

SEQ ID NO: 348042 - DNA, 620 bp, Homo sapiens
  misc_feature: GZ8MTXP02HRQCN.15.86.H09.1.454.CMB.2.raw
  modified_base (265)..(265): a, c, t, g, unknown or other
  misc_feature (265)..(265): n is a, c, g, or t
  modified_base (281)..(281): a, c, t, g, unknown or other
  misc_feature (281)..(281): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
  modified_base (336)..(336): a, c, t, g, unknown or other
  misc_feature (336)..(336): n is a, c, g, or t
  modified_base (397)..(397): a, c, t, g, unknown or other
  misc_feature (397)..(397): n is a, c, g, or t
  modified_base (424)..(424): a, c, t, g, unknown or other
  misc_feature (424)..(424): n is a, c, g, or t
  modified_base (464)..(464): a, c, t, g, unknown or other
  misc_feature (464)..(464): n is a, c, g, or t
tcagtctacgtagccacgaccggtgctcgatttagtgctatagacttggggtttggggggacttccctggtctccttctacctactgcccttcattttctccacaggtctctgtgctctgcctgtgctgactcacgcccccgtctgcatctgccttgcgtgggagcctcgatcaagctcacctgccaaccctaagtagtgagcactaccgaacctacaccatacgaagtgtatacaacagagacgaggactccccagtatataanagaaagtagagtgagnggacagccacgacggaaggggacggacnccgancgctcagtggctcgagttcggnggctcgaccgcctaccaccaccactccaccacctcacgtcgtagacgagtgagcgtagatnacgagtggacggaagacgtacaccaanaactagtcgagacggacgtaaaggggttggggtttggggngggtacggggacggggacgaaacggacgtaccggtcgaaccccggttagtacggaccgaccgaaccccgggtgcccccgtcccggtccctacggtacctccttcccgtaaccccgttcccccacccgttccgtacgttccgtaaacggtacgacgg

SEQ ID NO: 348043 - DNA, 631 bp, Homo sapiens
  misc_feature: GZ8MTXP02F9QN6.15.86.H09.1.454.CMB.2.raw
  modified_base (297)..(297): a, c, t, g, unknown or other
  misc_feature (297)..(297): n is a, c, g, or t
  modified_base (352)..(352): a, c, t, g, unknown or other
  misc_feature (352)..(352): n is a, c, g, or t
  modified_base (375)..(375): a, c, t, g, unknown or other
  misc_feature (375)..(375): n is a, c, g, or t
  modified_base (456)..(456): a, c, t, g, unknown or other
  misc_feature (456)..(456): n is a, c, g, or t
  modified_base (478)..(478): a, c, t, g, unknown or other
  misc_feature (478)..(478): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctcgagggagggctggagtgggtgacgttacaaaagtaaangatggtagaagaaatagactacggtgccaccggtagaaaggagatacacatctanaagagaataattaacaaaaacgnggtagttatttagacaaaatgaacagacctaagaaccgagacacacgccgtactattactgtaaccacagattcggaagtnacaagtacgaaacggtaaaggngactatgttactttgattagtcgtacgggacccgagggaacaagttcggtacgttcgtctccttacgacgtccctaccgaaaccgaccgggtaccctgtaccccggtttccctcccccggtcggacccctacccctacctaccgaaacgcccg

SEQ ID NO: 348044 - DNA, 590 bp, Homo sapiens
  misc_feature: GZ8MTXP02GRG06.15.86.H09.1.454.CMB.2.raw
  modified_base (228)..(228): a, c, t, g, unknown or other
  misc_feature (228)..(228): n is a, c, g, or t
  modified_base (310)..(310): a, c, t, g, unknown or other
  misc_feature (310)..(310): n is a, c, g, or t
  modified_base (327)..(327): a, c, t, g, unknown or other
  misc_feature (327)..(327): n is a, c, g, or t
  modified_base (418)..(418): a, c, t, g, unknown or other
  misc_feature (418)..(418): n is a, c, g, or t
  modified_base (530)..(530): a, c, t, g, unknown or other
  misc_feature (530)..(530): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaanagagaccaggaactccccagtatataatagaaagttaagagtgatggcagccacaacgaaggggacgactcccgatcgcttnagtggctccgagttcgnggggctcgaccgctacctccaccatcctaccaacctccgagtctagacagtgagctagtatacgtcacgtggaggagagacgaccaacaanaaatgaagtacggaccgtaaggtacggggtttggggtacgtttagggggcccggaaaggggacctaaaggcgtacggacccgttcggtaggcgacggacccgaaaggtcccncgtacccccgtggtacctacgtcctcgtacccccgtcctccgcgtacgtacctagaccgg

SEQ ID NO: 348045 - DNA, 677 bp, Homo sapiens
  misc_feature: GZ8MTXP02JQLJP.15.86.H09.1.454.CMB.2.raw
  modified_base (509)..(509): a, c, t, g, unknown or other
  misc_feature (509)..(509): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccgaggggagggctggagtgggttgacgtttacaaaagtaaaatgagtggtgaaagaaatagacgtacggtgacgacccgtaggaaaggagtacttcaactatctacaagagaattaataacaaaaacgtcggtagttatttacgactaaagtacgaacgacgtaccgaacggaaaccggagaaaccaacctacggtacccgttactttaagttacctacgtaacccataggtacgtttacggaaacgtnacgtagttaccggaaagtaaggacggtatacgttgttcttaggtatacgtacggtcgggaccgaggactacgttggtcgtcgtacttctcgactcccgaccacggaccggtcctcgtccgtaaccccgtaccccgttcggacccctacccttaccgaccgaacggccc

SEQ ID NO: 348046 - DNA, 692 bp, Homo sapiens
  misc_feature: GZ8MTXP02JIW3A.15.86.H09.1.454.CMB.2.raw
  modified_base (252)..(252): a, c, t, g, unknown or other
  misc_feature (252)..(252): n is a, c, g, or t
  modified_base (613)..(613): a, c, t, g, unknown or other
  misc_feature (613)..(613): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccnccgaggctccgaggggaaggggctgggagttgggttggtacgtttacaaaaagtaaaatgatggtagaagaaactgacgtacggtgcacccgtagaaaggagattcaccatctacaagagaataattacaaaaacgcggtgtattcgacaaagtgaaacacgacctagaaacccggaggtaaccacgtagcccgtactaacgttactgtaaaccactagaactttccgggaaagttcgactaacggttaccggaaacgtaaaagggacggtacttaagtgttactttttggaactttacggtcggtacgggggacccagggggtaaccaagttcgggttccgtcgtacctttctcgtaccnccgaccgaaccggacggtccctacgttcccggtccccgttcccccgacggtacccctacccgttaccgaaccgacgacg

SEQ ID NO: 348047 - DNA, 637 bp, Homo sapiens
  misc_feature: GZ8MTXP02JIV2X.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaaccgaagggggacggacgtccccgagtcgcttcagtgggctccgtagttcgtggggcctcgaccgctacctcccacctactcctaccaacctccacgtctgacgagtgagctagagtactcgaacttgggaggagacgacgcccaacaactaagttgaatcgggaccaaagggtccggggtttggggaggtttaccgggggaggtacgggaccgaacggcgtacggacccgtacgtacgggccaacggcccaaggggcccttacggtcccccccgttgggtacctaacccgttccgtaacccgttacccccgcccccgttacgtcccgaccctttaaccgggtgtaccgg

SEQ ID NO: 348048 - DNA, 673 bp, Homo sapiens
  misc_feature: GZ8MTXP02JMBVS.15.86.H09.1.454.CMB.2.raw
  modified_base (498)..(498): a, c, t, g, unknown or other
  misc_feature (498)..(498): n is a, c, g, or t
  modified_base (513)..(513): a, c, t, g, unknown or other
  misc_feature (513)..(513): n is a, c, g, or t
  modified_base (599)..(599): a, c, t, g, unknown or other
  misc_feature (599)..(599): n is a, c, g, or t
  modified_base (608)..(608): a, c, t, g, unknown or other
  misc_feature (608)..(608): n is a, c, g, or t
  modified_base (613)..(613): a, c, t, g, unknown or other
  misc_feature (613)..(613): n is a, c, g, or t
tcagtctacgtagccacgaccggtgctcgatttagtgctatagacttgggtttggggggaagaggaagactgacggtcccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggagggctggagtgggttgacgttacaaaagtaaaatgagtggtagaaagaaagtagacgtacggtgaccacccggtagaaaggaagtacttacacctatctacgaaagtagtaataaactttaaccgaaaaacggtacggttagttaatttacgactaaaagtacgaaacgacgacccgtaacgaaaccggacggaacaccgacgtcccgtattaactacgtacgaaccanagtagttacggagtnacagtaccgaagaaacgggtgtactgtacgttacttttaggacttacggttcggacggggacccagggaacctagtcggtcgtacncgtttaccncgacncccgaccgacgccgtcctcgtcccgtccgtcccgcgaccctaccctaccgacgacgtccg

SEQ ID NO: 348049 - DNA, 653 bp, Homo sapiens
  misc_feature: GZ8MTXP02FWFGJ.15.86.H09.1.454.CMB.2.raw
  modified_base (330)..(330): a, c, t, g, unknown or other
  misc_feature (330)..(330): n is a, c, g, or t
  modified_base (505)..(505): a, c, t, g, unknown or other
  misc_feature (505)..(505): n is a, c, g, or t
  modified_base (622)..(622): a, c, t, g, unknown or other
  misc_feature (622)..(622): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctccgagggaaggggctggagtggggttggacgttacgaaaagtaaaatgatggtagaagaaatagactacggngcaccgtagaaaggagattcaccatctacaagagataattacaaaaacgacggtagtatttgactaaatgaacagaccgtaagaaaccgaggacacgacgccgttacttacttactacgtacccaactagtaacgttacgggaagtggactaagtaccggaaacggtaaaagggngtaaccttagtgttactttagagttactcggtacggggcccaaggggactaagtcggtcgtacgtctctcgacgccctacaccgacggtcccacgttccggtaaccccttcccccgnggtacccctacccgtcctaccgaaggtcccg

SEQ ID NO: 348050 - DNA, 782 bp, Homo sapiens
  misc_feature: GZ8MTXP02HAG5T.15.86.H09.1.454.CMB.2.raw
  modified_base (371)..(371): a, c, t, g, unknown or other
  misc_feature (371)..(371): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatggtatacaacagagaccagggaacgtccccagtatataatagaaagttaagagtgatggcagaccacgaccggaagggggacggacgtccccgagtcgtacttcacgtgggtcctcgtacggttcggtggggctacgaccgtaccttaccnccccacctactaccctaccctaaccctaccgtaacgtccgtacggaaccgtagtaggacggtacgtagtaaagggttctaccgtaaacggttggggagggaaaagaccggacgaccccttaaaaccgaagttaaaagttccgggaagttaaccggggaaaccccgtaaaagggggtttacccgggggtttggggtttaacggggtcccgggggtaacgggggaaaacccggggtacccaaagggtccccgttagggaaccccccggtttaggtaaacggggcccaaccgggtaccccggaaggggtcccctaccccggtcccccggttacgggtcccaaaccggtttccgttccccggttaacccccggcccctttccggcgtaccccgttaaaacggggttcaaccgggg

SEQ ID NO: 348051 - DNA, 638 bp, Homo sapiens
  misc_feature: GZ8MTXP02HVG68.15.86.H09.1.454.CMB.2.raw
  modified_base (415)..(415): a, c, t, g, unknown or other
  misc_feature (415)..(415): n is a, c, g, or t
  modified_base (426)..(426): a, c, t, g, unknown or other
  misc_feature (426)..(426): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcaccctgcaccctaagtagtgagcatcgaacctacaccatcgaatggtatcaaacagacgaccgagggaactcccccagtatataatagtaaagttaagagtagatggcagccacgaccgaagggggacggacgtccccgagtcgacttcagtcgggctcgagttcgtggggctgaccgctacctccaccatccacaacctccagtctgacgatgagcgtagacgtctcacgtgaggganagtacgccaanaacaagttagagtacggaccgtaaagggttccgggggtttggggtcgttaccgggggacgggaagggaacccaaagggtccggaccgtaaccggtccgtaaggggacccacggacccccgtaaggggccccttccggccccccgttggtaccacccgttccgttcccgtccccccgaccctttccgaccggtacgttacggtaacgccgggg

SEQ ID NO: 348052 - DNA, 617 bp, Homo sapiens
  misc_feature: GZ8MTXP02FN3A3.15.86.H09.1.454.CMB.2.raw
  modified_base (567)..(567): a, c, t, g, unknown or other
  misc_feature (567)..(567): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacaccgaaggggacggactccccgatcgcttcagtgggctccgagttcgtggggctcgaccgctacctcccaccactcctaccaaccctccaagtctgacgagtgagctgagtatcactggtacggagagacgccaacaactaagttagaacgttacgggacccgtaaagggtccggggtttaggggtcggttacggggacgggaacggggaaccaaggcttacgggacccgtccgtaaggtccaacggacccgaacggcctacccggcccccgtcggtaccncccggtttcgtcccgttccccgcccttccgcgtaccgtacgtacgtaccg

SEQ ID NO: 348053 - DNA, 713 bp, Homo sapiens
  misc_feature: GZ8MTXP02HZ1GG.15.86.H09.1.454.CMB.2.raw
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttggtaaagccgtgggggtcccttagagtctccgtgtgtggcctctggattcacttcagtaatggctggatggaggttcgggtccgccgaggcctccggaggggaaggggcgtgggaggttggggttggtaacgtttaacgaaaaagtaaaagtagtagtaggtagaaagaaaagtacgacgtaacggtgacccgtacccgtaggaaaaggaaacgtacgttaccacctatacctaacgaaagaaataaacttaaacttaaacgaaaaaacggtacggttaagtttagttacgaactaaagtacgaaactacgaccgtaaacggaaaaccggaagaaccgactacggtaccgttacttaaacgtttacctaagtacccgaaatacgtagttacgggagtacgctaagtaaccggtacgtaaaagggtcgacttaaggttagtttaccgtttagacgtttaaacggtccggttacgggggaaccccg

SEQ ID NO: 348054 - DNA, 700 bp, Homo sapiens
  misc_feature: GZ8MTXP02IMVU2.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaaacagagaccagggaacgtcccccagtataataatagaaagttaagagtgatggcagccacaccggaaggggacggactccccgatcgctcagtcgggctccgagttcgtggggctcgaccgctacctccaccctactcctacccaaccctccgacgtctcgaacgagttgaggtctagagtaatccgacgttggaggaagagacgccaaacgaactaagttcgatacgggacccgtaaaggtccgggggtttgggtcggttacgggggacccgggggaaggggaacccaaacggtccgtcggtaaacccccggtccggtttaacgggtacccgaacgggacccccgaaaagggtcccgttaccccggcccccccgttcggggttaccctaacccgttccggtttaaccccgggttcccccctccccggttcccccttacgggtaccccctttaaacgggttacgtaaccccggg

SEQ ID NO: 348055 - DNA, 833 bp, Homo sapiens
  misc_feature: GZ8MTXP02FRE86.15.86.H09.1.454.CMB.2.raw
  modified_base (795)..(795): a, c, t, g, unknown or other
  misc_feature (795)..(795): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctgggaggtggggttggacgtttacaaaagtaaaatgatggtagaagaaaatagacgtacggtgaccaacccggtagaaaaggagtattaccaaccatctacaaagagtaattaaactttaccgaaaaaaacggtacgggttagttaacttttaggaacctaaaagtacgaaacagtacccgttaaacggaaacccgggaagggaaccaaacgtacgtacccggttacttaactttaaccgttacgttaaacccgaaacgtaaggttaaacgttttaccgggggaaaggttacgggacctaaacggtaaccgggtaaaaccgggttaaaaagggggacgggttaaaccgtttaaagttcggttaccgttttttaggaatttaagggtcccggtacgggggtacccccgaagggggtaaaccaaggtttccggggtaccgttcgttcccgtacgtttcaccggtccccttaccgaacccggtacccggggaccctaccggtttcccgtcccgtttaccccccgnggaccccctacccccgttacctacccgaacggaccccg

SEQ ID NO: 348056 - DNA, 676 bp, Homo sapiens
  misc_feature: GZ8MTXP02FSJ3X.15.86.H09.1.454.CMB.2.raw
  modified_base (453)..(453): a, c, t, g, unknown or other
  misc_feature (453)..(453): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccaggaacgtcccccagtatataatagaaagttaagagtgatggcagccacgaccgaagggggacggactccccgagtcgcttacagtcggctacgtaaggtcggtaggggctcgaccgtctacctccacccactcctaccctaacctccgacgtcgtacgacgtagtagacggtacgtaggaatactccacggttgggaggaagacgacgaccccaaanaactaagttgaacgttacggggacccgtaaaaggggttccggggtttgggggtacgggttaccggggaacggggaccggaaccgaaggtccgttaacggacccgttacgaggggtacccacggaccccggtaggccccgttacccggcccccgttggtaccctcgttccgtccccgtttcccccaacccgttcccgtaccggtacttaacccggtacggaccg

SEQ ID NO: 348057 - DNA, 639 bp, Homo sapiens
  misc_feature: GZ8MTXP02FEKNF.15.86.H09.1.454.CMB.2.raw
  modified_base (365)..(365): a, c, t, g, unknown or other
  misc_feature (365)..(365): n is a, c, g, or t
  modified_base (381)..(381): a, c, t, g, unknown or other
  misc_feature (381)..(381): n is a, c, g, or t
  modified_base (407)..(407): a, c, t, g, unknown or other
  misc_feature (407)..(407): n is a, c, g, or t
  modified_base (423)..(423): a, c, t, g, unknown or other
  misc_feature (423)..(423): n is a, c, g, or t
tcagtctacgtagccacgaccggtgctcgatttagtgctatagacttggggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatacaacagagaccagggaactccccccagtatataatagaaagttaagagtgatggacagccacaccggaaggggacggactccccgatcgacttcagtgggctcctagtcgtggggactcgaccgctactaccacctacnctccaacctccagtcngacgatgacgctgagtaatcacgtgnggagaagacgacctanaactaattacgaagtcgggaccaaagggtcgggtttggggtcgttacgggggaggaacgggtaaccgaagccgtcggacccggtacgttaaacggggcaaccggacccaaagggggccctaccggtacccccccgtcgggtttaacccctaccgttacccgtccccgttacccccgtacccccttaccgtaccgtaccgtaaccggtacggtaccg

SEQ ID NO: 348058 - DNA, 722 bp, Homo sapiens
  misc_feature: GZ8MTXP02JIPZ0.15.86.H09.1.454.CMB.2.raw
  modified_base (347)..(347): a, c, t, g, unknown or other
  misc_feature (347)..(347): n is a, c, g, or t
  modified_base (387)..(387): a, c, t, g, unknown or other
  misc_feature (387)..(387): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacttacaccatcgaatggtatcaacagagaccaggaacgtcccccagtatataatagaaagttaagagtgatggcagccacaccgaaggggacggatccccgatcgctcagtggctccgagttcgtggggctcgaccgctaccncaccatctaccacctcagtctgacgatgagctggatactnacgtggtacgggaagaagactccaaacacgtaaattggaacttacggggacccaaaaggggttccggggtttgggggtaggttaccgggggacgggtaaacgggggaaacccaaaggggtcccgtacgggaaacccccggttccgttaaacgggggtacccgaaaacgggtaccccccggtaaaagggggcccccttacccggggtaccccccccccgtttgggggtaaacccccttaccggttcccccggtttaaccggggttttcccccccccgtacccccgtttaccccgggtacccggtaacccggtttaaacccgggttaacggtaccgg

SEQ ID NO: 348059 - DNA, 688 bp, Homo sapiens
  misc_feature: GZ8MTXP02GUYEM.15.86.H09.1.454.CMB.2.raw
  modified_base (328)..(328): a, c, t, g, unknown or other
  misc_feature (328)..(328): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccaggaacgtcccccagtatataatagaaagttagagtagatggcagccacacgaaggggacggactccccgatcgctcagtggctcgagttcgngggctcgaccgctacctcccaccactctacctacctccagtccgtagaccgtagtcgacggtctagactacgtcctaacggttggcggggaagtagggaacgcccgaaacaccgtaaaattcgggaacgttacgggaacccggttaaaaggggtccgggggttttacgggggttacgttccgggggaccgggaacgggttaaacccgaaggtcccgtacggacccggttacgtacggtaccgaaacgtccccggaaagtccccgttaccggaccccccgttcggtacctaacccgtttcgtaaccccggtttccccccaacccgttcccttaaccggtaccgttaccggtacgtacccgg

SEQ ID NO: 348060 - DNA, 565 bp, Homo sapiens
  misc_feature: GZ8MTXP02J0SZ7.15.86.H09.1.454.CMB.2.raw
  modified_base (357)..(357): a, c, t, g, unknown or other
  misc_feature (357)..(357): n is a, c, g, or t
  modified_base (405)..(405): a, c, t, g, unknown or other
  misc_feature (405)..(405): n is a, c, g, or t
  modified_base (543)..(543): a, c, t, g, unknown or other
  misc_feature (543)..(543): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaccgaaggggacggactccccgatcgcttcagtgggctccagttcgtggggctgaccgctacctcccaccntctaccacctccagtctgacactgaggctgagtatcacgtgtaggganagacgtccaacaacaattgaatcgggaacctagggtacgggttgggttgtcggggacggaggggaccaagcgtgacccggtcgtagcgacgaccgaacgggcctacccggccccgttcgctaccctctccgtaccccnccctcgtcgcctacggtagccg

SEQ ID NO: 348061 - DNA, 676 bp, Homo sapiens
  misc_feature: GZ8MTXP02HZ8CG.15.86.H09.1.454.CMB.2.raw
  modified_base (335)..(335): a, c, t, g, unknown or other
  misc_feature (335)..(335): n is a, c, g, or t
  modified_base (353)..(353): a, c, t, g, unknown or other
  misc_feature (353)..(353): n is a, c, g, or t
  modified_base (403)..(403): a, c, t, g, unknown or other
  misc_feature (403)..(403): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccaggacgtcccccagtatataatgaaagttaagagtgatggcagccaacgaccgaagggggacggactccccggatcgcttacagtggactcctagttcgnggggctcgaccgctaccnccacatcctccaacctccagtctgacgagtagacggtctaggagttaacncgtaggtggagggaacgaagacccgacaaactaagttacgtaggtaacggtacgggaaacggttaaacgggggtttcgggggttcgggttacggggtacgggggaaccggaaccgggaacgtacggtccggtaaacgccccgttacgggtaacgacccggtacccggaccgtaccgggtccctacccccggtacccggttcggtacccttcccgttaccgttcccccgttacccccgacccgttccggtacctaaccggtacggtacgtccgg

SEQ ID NO: 348062 - DNA, 949 bp, Homo sapiens
  misc_feature: GZ8MTXP02IBSFG.15.86.H09.1.454.CMB.2.raw
  modified_base (231)..(231): a, c, t, g, unknown or other
  misc_feature (231)..(231): n is a, c, g, or t
  modified_base (301)..(301): a, c, t, g, unknown or other
  misc_feature (301)..(301): n is a, c, g, or t
  modified_base (332)..(332): a, c, t, g, unknown or other
  misc_feature (332)..(332): n is a, c, g, or t
tcagtctacgtagccacgaccggtgctcgatttagtgctatagacttgggtttgggggaagaggaagactgacggtcccttagagtctcctgtgtggcctctggattcactttcagtaatggctggatgagttgggtccgccaggctccagggaaggggctggagtgggttggacgtttcaaaagtaaaatgatggtgaagaaatagactacggtgcacccgtgaaagganattcaccatctacaagagaataattacaaaaacgcggtgtatttgacaaatgaacagcctagaaaaccgnggaacacagccgtactattactgtaacccanaagagtttacggaagtcgaccaagttaccggaaacgttaaaagggacggtctaagtcgttaccgtttttagaacgttataccgggtccgggggaccccctaaggggtaactaaaggttcgggttaccgggttccgttcttccgtttacccgaacgtccccccgttaccgaaaccccgtaaacccgggggccccctaacggtttcccccggggttaccccctttccccccccggtgggggtaccccctaaacccccccgtttccccttaaccccggtaaaaccgaccggtcccttaaacccccgggttacccggggttccgggggggaacccctaaacccggggacccgggtcccccgggggacccccggttaccggggggtaccctttacccggggtcccccggtttaacgggggtttaaccccgaaaaaccgggggttcccccgtttaaacccccggttttccccgggaacccggttttaaaccccgggtaaacggtttaaacccccgggggtacgggggtaaacccgggggtcccgggggttaaccggttaaccgggggaaccccggtaaacccgggggtacccggtaacggttaaacggtacggtcgtacgtcg

SEQ ID NO: 348063 - DNA, 740 bp, Homo sapiens
  misc_feature: GZ8MTXP02H6LAJ.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatacgaacctacaccatcgaatggtatacaacagagacgagggactccccagtatataatagaaagttaagagtgatggacacgaccacgaaccggaaagggggaccgggactaccccgacgtccggtctaccgaagtcggggtcctaccgtaggttcggtcggggctacggaccgtacctacctcccacctactccctaccctaaccctaccgtacgttccgtacgtaacgtacgttacggaacggtccgtagtaacggttactacccgacggtttagggacggggaagaacgggaccgttaaaccccaacgtaaacctaaaggtttcgaaaggttaccgggaacccgttaaaggggtacgggggttttagggggtcggttacgggggacccgggggaagaaaccgacggtaccgtacggtaaccccggttagaccggggtaccacgggaccccgaaggtccacccggtcccccgtaaggccttccggtccttcccccgtaccccgtacccctaccggttcaccggtttacgtaacggccgg

SEQ ID NO: 348064 - DNA, 554 bp, Homo sapiens
  misc_feature: GZ8MTXP02FXT5I.15.86.H09.1.454.CMB.2.raw
  modified_base (367)..(367): a, c, t, g, unknown or other
  misc_feature (367)..(367): n is a, c, g, or t
  modified_base (443)..(443): a, c, t, g, unknown or other
  misc_feature (443)..(443): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttagagtgatggcagccacaccaaggggacgggatccccgatcgcttcatgggctccagttctggggctgaccgctacctccaccatctccaacctccagtcngacgatgagctgagtatcactgtaggagagacgccacacaattgatggacccaaggaccgggttgggtgttcgggngggaacgggccaagctacggaccgtccgtaaggtccacggccctaaagggcctcgccccccgtcggtccacgtcctcgttccccgccctccgtcgaccgttactaggaccg

SEQ ID NO: 348065 - DNA, 584 bp, Homo sapiens
  misc_feature: GZ8MTXP02FL4Z6.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggactccccgatcgcttcagtgggctccagttcgtggggctgaccgctacctcccaccactcctaccaacctccacgtctagacgagtgagtctagagtatcacgtgtaggagagacgccaacactaattgagtaggacccaaagggtacgggttggggtacggttacggggacgggtacggaccgaagcgtacgacccgttcgtaggaccacggacccgaaggccctccggccccctcggtccacttccgtcgtcccctacccgtcctcgtacgtaccgtacgacg

SEQ ID NO: 348066 - DNA, 638 bp, Homo sapiens
  misc_feature: GZ8MTXP02IBEZ7.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgcgtgggagcctcgatcaagctcacctgcaaccctaagtagtgagcatacgaacctacacatcgaatggtatacaacagacgacgacggaacgtccccagtataataataagtaaagtaagagtagagtcggacacgaccgaaccgaaccggaaagggggaccggactccccgagtccgtctcgagtcggtctccgtagttcggtgggctcgacccgtctacctacccacctactcctacccaacctccgtacgtccgtacgacgtagtacgaggtcgtagtaatctaccgagttgggagaaagcgaacgtaccaataactaagttgacgtacgggctaaaggggtcgggtttgggtacggtacgggggacggtaacgggaccaggtcgtacggtacccgtagtacgacgacgaccgtacggtccttcccggcccgtcgtactcctccgttcccgaccctcccgtcgcgtacgtacgtacgcg

SEQ ID NO: 348067 - DNA, 646 bp, Homo sapiens
  misc_feature: GZ8MTXP02FQ7AT.15.86.H09.1.454.CMB.2.raw
  modified_base (437)..(437): a, c, t, g, unknown or other
  misc_feature (437)..(437): n is a, c, g, or t
  modified_base (483)..(483): a, c, t, g, unknown or other
  misc_feature (483)..(483): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctggggagccttggtaaagcctggggggtcccttagagtctcctgtgtggcctctggattcacttttcagtaatggctggatgagttgggtcgccaggctccgagggaaggggctggagtggggttggacgtttacaaaaagtaaaatgatggagagaaaatagactacggtgcaccgtgaaagagattcacatctcaaagagataattacaaaaacgacggtgttatttgacaaaatgaaacagcctagaaacccgaggaacacagcctctaattacngtaacccacagatttcggaaagtgacataccggactaaaaaggggngactagtgtcttttagattacgcggtacggggacccgaagggaactagtcggtccgttcgtcttccttacacgtcccctacccgaaacccgaacggggtcccctaacgttcccgtcccccttcccccggtacgaccccctacccctaccaaccgaacggaccg

SEQ ID NO: 348068 - DNA, 770 bp, Homo sapiens
  misc_feature: GZ8MTXP02HNV2B.15.86.H09.1.454.CMB.2.raw
  modified_base (352)..(352): a, c, t, g, unknown or other
  misc_feature (352)..(352): n is a, c, g, or t
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtcgtggggagccttggtaaagccgtgggggtcccttagagtctcctgtgtggcctctggattcactttcagtaatggctggatgagttcggtccgcaggctccgagggaagggcgtggaggttgggttaggtacgtttacgaaaaagtaaaagtgagtaggtagaagaaatagactacggtgcaccgtagaaaganacttacacatctacaagagtaataataacaaaaacgtacgtagttatttagaactaaagtacaaacgaacgtacctaacggaaaccggtaggaaaccaacgaaccgtaccgttaacgtactttaacctacgttaaaccaacgtacgaaacgtttacggaaagtacgactaagtaacggaaaccggtaaaaggacgtagtttatcggtttacttttagtacgttaaggtccggttaccgggggacccgtaaacgggtaaccgttaagggttccgggttacgggttccgttaacgtttcccgttaacgtacccgtaccccgtaccccgtaaaccggaccgggaccccttaccggttaccccgtttcccgttcccccgtaccggtccccaacccccgtttcccaacccgtaacggaacccg

SEQ ID NO: 348069 - DNA, 755 bp, Homo sapiens
  misc_feature: GZ8MTXP02FRQZP.15.86.H09.1.454.CMB.2.raw
  modified_base (167)..(167): a, c, t, g, unknown or other
  misc_feature (167)..(167): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctggggganccttggtaaagcctggggggtcccttagagtctcctgtgtggcctctggattcactttcagtaatggctggatgagttgggtccgcaggctcgagggagggctggagtgggttgacgttacaaaagtaaatgatggtagaagaaatagactacggtgcaaccgtgaaaggagacttcaccatctacaagagataaattaacaaaaacggtcggtattatttagactaaatagaaacagacctaagaaccgaggaactacgacgtccgttactattactacgtaaccacgtagtaacgttacgggaaatcggacctaacggtacggaaaccgggtaaaagggtaggtaccgttaagttggttacctttttaaggaactttacggtaccggttaccgggggtaaccccgaagggggtaacgttaaaacggttccgggggttaaccgtccgggtttccctacgtttacccggaccgtaccccgttaacccccgaaacggggtaaacccgggccccctaacggttcccggtttaaccccctccccccggttagacccccctaccccctttccgaacccgtaaacgtccccgg

SEQ ID NO: 348070 - DNA, 640 bp, Homo sapiens
  misc_feature: GZ8MTXP02FJH5Z.15.86.H09.1.454.CMB.2.raw
  modified_base (370)..(370): a, c, t, g, unknown or other
  misc_feature (370)..(370): n is a, c, g, or t
  modified_base (639)..(640): a, c, t, g, unknown or other
  misc_feature (639)..(640): n is a, c, g, or t
tcagtctacgtagccacgaccggtgctcgatttagtgctatagacttgggtttggggggaagaggaagactgacggtcccttagagtctcctgtgtggcctctggattcactttcagtaatggctggatgagttgggtccgccaggctccagggaaggggctggagtgggttggacgtttcaaaagtaaaaatgatggtgagaaaatagactacggtgcacccgtgaaaggagattcaccatctcaagagataaattacaaaaaacgacggtgtatttgacaaatgaaacagcctagaaaaccgagaacacagccgtctattactgtaccacagattcggaagtgcatcgaacgtaaaggaggctagtgntttgatatcgtggggcccagggacaagtcggtcgtcgtctcttcacgccctccaaccgaaacgggccctacgtcccgggttccctttaccccccgtggacccctaccccctccctacccaacgtacgccacccgtcgtcgggggaccaccggacggcccgggtccccgtgggggcctcggcccgtcggtaccgaaacggggtacctaccgttcccgtacttacgtaacgacgtaggacgcgggcgtggaaccgaggcgacagtacggcnn

SEQ ID NO: 348071 - DNA, 695 bp, Homo sapiens
  misc_feature: GZ8MTXP02HBZK2.15.86.H09.1.454.CMB.2.raw
  modified_base (231)..(231): a, c, t, g, unknown or other
  misc_feature (231)..(231): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgccaccctaagtagtgagcatcgaacctacaccatcgaatggtatacaanagacgaccgacggaacgtccccagtatataatagaaagttagagtgagtggacacgaccgacgaccggaaggggaccggaccgtccccgagtcgcttcgagtcggctcgtacgtcggtgggctcgaccgcctaccaccccgaccacctcccgtacctaacctccacgtccgtgacgagtagacgtgtagtagtacttcgacgttggaggacgagacgaccaacgacgttaagtcgagtaccgggaccgtaaaggggttccggggtttaggggtccgggttacgggggacgggtaacgggacccgaacggtccgtaccggtacccggtacgttaccgggacccgaaacgggtcccgaacgggtccccgtcccggacccccggttcgtacccctaaccgtttcccgtaaccccgttacccccgacccctttccggtaccctaccggttaaccgtacggtaaccggg

SEQ ID NO: 348072 - DNA, 792 bp, Homo sapiens
  misc_feature: GZ8MTXP02IC8EH.15.86.H09.1.454.CMB.2.raw
  modified_base (272)..(272): a, c, t, g, unknown or other
  misc_feature (272)..(272): n is a, c, g, or t
  modified_base (444)..(444): a, c, t, g, unknown or other
  misc_feature (444)..(444): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctggggggagccttggtaaagccgtggggggtcccttagagtctcctgtgtggcctctggattcactttcagtaatggctggatgagttgggccgcaggctcgaggggagggcngggagtggggttggacgtttacaaaaagtaaaatgatgggtagaaagaaaatagacgtacggtacgaacccgtagaaaaggaagattacaaccatactacaaagagaaataaattaacaaaaacgtacggtagtattagaaccaaaatagaaacagacctaacggaaaacgnggaacaacgacgtaccgtacttaatactacgaaacccacgaagtaacgttacgggaaagtcgactaacgtaacggaaacggtaaaagggacggtacttagttcggttacgtttttaggtaaacttaagttccgggtaccgggggtacccctaaagggtaacgggtaaacccgtaaagggtttccgggttcccggtttaccggttccctttacgtttacccgaaccggttaccccctaccccgaaaccccggtaaccggggaccccctaacgtttaccccgggttcccccgtttccccccggtacggtacccccctaccccttaccccgtaacccgaacggtaaccccg

SEQ ID NO: 348073 - DNA, 758 bp, Homo sapiens
  misc_feature: GZ8MTXP02IJI82.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatacaacagagaccaggactccccagtatataatagaaagttaagagtgatggcacgaccaacgaccggaagggggaccggacgtccccgagtccgtcttacgagtcgggtcctccgtaggttcggtggggcctacgaccgtcctacctacccacctactccctacctaaccctcctacgtctacgacgtagtggacggtcgtagtagtaactcgacgttaggagggaagaacgacgacccaactaaacgtagttacgaacggttacggacccggttaaaaggggttcgggggtttacggggttacggggtttacccgggggaacggggtaacggggtaacccggtaaacgggtccgttaacccggggtacccgttaccggttaacgggtacccggaaccgggacccccgtaaagggtcccccgtaaacccccgggtcccccgtttccgggtaacccttcccgtttccccggtcccgtttccccccggtaacccgtttcccccgtaacgtcccggttaaaccggtacggtaacccgg

SEQ ID NO: 348074 - DNA, 754 bp, Homo sapiens
  misc_feature: GZ8MTXP02FYI0A.15.86.H09.1.454.CMB.2.raw
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttcgggtccgccgaggctcgagggagggctggagtggggtgacgttacaaaagtaaatgatggtagaagaaaatagactacggtgaccaccggtagaaaggagtataccactatctacaagagaattaattaaccgaaaaaacggtacggttagttaagtttcgaactaaaagtacgaaaacgacgacccgtaagaaaaccccgggaggaaaccaaaccgtaccgtacccggttactaaacgtttacctaacggtaacccaaacgagtaacgtttacggaaagttcgacctagtacggaaacggtaaaaggcggtacttaagttgtacgttttagagttacgttcggaccggggtacccgaaggggtactaacggttcgggtaccgttcgtaccttcgttaccgaccgtaccccgtacgaaacccggtaaccggggacccctacggttccccggtcccctttcccccgacggtcccccttaaccccgtccccttaaccggaacgtccccg

SEQ ID NO: 348075 - DNA, 763 bp, Homo sapiens
  misc_feature: GZ8MTXP02IIC8N.15.86.H09.1.454.CMB.2.raw
  modified_base (328)..(328): a, c, t, g, unknown or other
  misc_feature (328)..(328): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgcagctcgagggagggctggagtgggttggtacgtttacaaaagtaaatgatggtagaagaaatagacgtacggngacacccgtaggaaaggagtatccaccatctacaagagtaattaataacgaaaaacgtcggtagttatttagaactaaagtacgaaacacgtaacccgtaacggaaaccggaggaacctaacgtaaaccggtcccgttacttaaactttacctacgttaaacccaacgtaaggtagtttaccgggaaaagttcgacccgtaaagttacccgggaaaacggttaaaaagggggtcgtaacgtttagttacggtttagttttaagacgtttacggtcggggtaccggggaccggtaagggtacgttacgggttcggttaccgttaccgttacttacctcgacccgtccctaacccggaaccggtaccggtcccttaccgttcccccggttcccgttacccccgacgtaccccctacccgttaccctaacgacgtacc

SEQ ID NO: 348076 - DNA, 646 bp, Homo sapiens
  misc_feature: GZ8MTXP02ISNNM.15.86.H09.1.454.CMB.2.raw
  modified_base (566)..(566): a, c, t, g, unknown or other
  misc_feature (566)..(566): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgcgtgggacgcctcgatcaagctcacctgcacctaagtagtgagcatcgaacctacaccatccgaatggtatcaacagacgacgaggaacgtccccagtactataagtagtaaagttaagagtgatggacagaccacgacggaaggggacggactcccgatcgctcgagtcgggtctcgtagttcgtggggctacgaccgtctacctcccacctactccctaccaaccctccgacgtcgtagaacgagtcggacgtcgtaggtaattacgtcgtacggttgggaagggacgaagacgacccctaaagacttaaagtacgagttacggaaccgtaaggggtacgggttgggtcggtacgggacgggacgacacgtcgtacgtaccgttcgacggtccacggaccaagggtccncccggtccccgtcggtaccctccgtttcggtcccccgttccccgcccgttccgtacgacccgtttaacggacgtaccggg

SEQ ID NO: 348077 - DNA, 734 bp, Homo sapiens
  misc_feature: GZ8MTXP02IZP4U.15.86.H09.1.454.CMB.2.raw
  modified_base (447)..(447): a, c, t, g, unknown or other
  misc_feature (447)..(447): n is a, c, g, or t
  modified_base (668)..(668): a, c, t, g, unknown or other
  misc_feature (668)..(668): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagaagaccgaggaacgtcccccagtatataatagaaagtaagagtagatgcagcaacgacggaaggggtacggctccccgatcgctcagtggctcgtagttcgcggcgtgaccgcctacctcccaccacctcctacccacctacctacgtccgtcgaccgtagtagtacggtggtacgtacggttaactacccgtcgttagggtaacgggaagggaaccnccggtttaaacccaacccgttaaataaacggtttacgaaggttaacccggggaaccccgttaaaaggggttaccgggggttttgggggttaccggtttacgggggacccgggggtaaaacggggacccaaagggtccgttaccgggaacccggttcgttacggggaacctaccggacccgttaaacggccttacccccggaccccgtcccgggtttaaccncccttaccggtttcccgttaccccccacccgtttacccggcttaacccggtacgttaaacggccgg

SEQ ID NO: 348078 - DNA, 573 bp, Homo sapiens
  misc_feature: GZ8MTXP02FV4AU.15.86.H09.1.454.CMB.2.raw
  modified_base (328)..(328): a, c, t, g, unknown or other
  misc_feature (328)..(328): n is a, c, g, or t
  modified_base (367)..(367): a, c, t, g, unknown or other
  misc_feature (367)..(367): n is a, c, g, or t
tcagtctacgtagccacgaccggtgctcgatttagtgctatagacttggggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacaccgaagggggacggatccccgatcgcttcatgggctcagtcnggggctgaccgctactccaccatctccaacctccagtcngacgatgagctgagtatcactgtggacgagacgcctaacacaattagatacgggaccaaaggtaccgggtttgggggtcggttcggggacgggaggggtaacccaaggccgtcggacccgtccgtaggcgaacgccccgaagggccctcgccccccgtacggtccactccgtcgttcccccgccctccgtcgacttacgacgaccg

SEQ ID NO: 348079 - DNA, 599 bp, Homo sapiens
  misc_feature: GZ8MTXP02I9UN3.15.86.H09.1.454.CMB.2.raw
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctgggagtggggttggacgtttcaaaagtaaaatgatggtgagaaatagactacggtgcaccgtgaaaggagatcacatctcaagagataattacaaaaacgacggtgtatttgacaaatgaacagacctagaaccgaggacacagccgtactattactgtaccacagattcggaagtgcatcgaacgtaaaggagactatgtacttttagattagtcgtggggcccagggacaaagtggtacgtcgtctcgttcacgccctaccaaccaacgggccccacgtccggtcccttcccccgtaggcccctaccccgtccctaccaacgacg

SEQ ID NO: 348080 - DNA, 689 bp, Homo sapiens
  misc_feature: GZ8MTXP02HQ9NP.15.86.H09.1.454.CMB.2.raw
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctcgagggagggctggagtgggtgacgtttacaaaagtaaaatgatggtagaagaaatagactacggtgacacccgtagaaaggaagatcaccatctacaaagagtaattaattaacgaaaaaacgtacggtagtaatttcgacaaagtcgaaacgagacccgttaagaaacccggtaggaacacgacgtccgtacttaattactacgtaaccaacgaagtacgtttacgggaaagttcgactaagtaccggaaacggtaaaagggtaggacttaagttcggtacttttttaggaattacgtcgtacgggggacccgaaggggacctaagttcgggtctcgttctcttcacgtccctaccgaacgaacgggtccctaacgtccggttaacccttcccccgcggaccctaccccgtacctaccgaacgtacccg

SEQ ID NO: 348081 - DNA, 560 bp, Homo sapiens
  misc_feature: GZ8MTXP02F42CM.15.86.H09.1.454.CMB.2.raw
  modified_base (350)..(350): a, c, t, g, unknown or other
  misc_feature (350)..(350): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaactcccccagtatataatagaaagttaagagtgatggcagcacacgaggggacggatccccgatcgcttcagtggctccagttcgtggggctcgaccgctacctccaccnctctccaacctcagtctgacgatgagctggatatcgatggtgganggtacnccaanacgtagtgagacggacgaggtcgggtgggtcggtacggggacggacgacgagcgtacggaccgtacgtaggacaccggcgacggcccgtaccgtccccgtcgtacctccttccgtcccgttaccccaccgtccgtacgtaccgtacggtacgcg

SEQ ID NO: 348082 - DNA, 779 bp, Homo sapiens
  misc_feature: GZ8MTXP02G90YH.15.86.H09.1.454.CMB.2.raw
  modified_base (276)..(276): a, c, t, g, unknown or other
  misc_feature (276)..(276): n is a, c, g, or t
  modified_base (738)..(738): a, c, t, g, unknown or other
  misc_feature (738)..(738): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattctactttcagtaatggctggatggagttcgggtccgccaggctccgaggggagggngtggaggtgggtggacgtttacaaaagtaaatgatggtagaaagaaatagacgtacggtgaccgaccgtaggaaaaggaagtacttaccaacctatacgtacaaagaagtaaataattaaaccgaaaaacgtacggttatatttacgaactaaagtagaaacacgtacccaaggaaaccggaggaaccaacgacgtaccgtactaacttacgtaccgtaacacgtagtacgtacggtaagtacgtaccagtaacggtaaacggaaagggacggtacgttagttagtttacgtttagtaaccgttagttaccggggtaacggggtaccccgaaaggggttaactaaacgggtttcgggttaccggttaccgtttccttccgtttacccgaaccgggtccccctaaacccggacccggtaaaccgggtccccctaacggtttccccgtccccgtttaacccccncggggtacccccctcccgtacccgtaacccaaccggcccgg

SEQ ID NO: 348083 - DNA, 534 bp, Homo sapiens
  misc_feature: GZ8MTXP02ICQZC.15.86.H09.1.454.CMB.2.raw
  modified_base (400)..(400): a, c, t, g, unknown or other
  misc_feature (400)..(400): n is a, c, g, or t
  modified_base (519)..(519): a, c, t, g, unknown or other
  misc_feature (519)..(519): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgaggcatcgaacctacaccatcgaatggtatcaacagagaccagggaacgtcccccagtatataatagaaagttaagagtgaatggcagaccacgaccgaagggggacgggatcccccggatcggcttcagtgggctccgagttcgtggggctgaccgtctactcaccatctaccactccagtctgacatgagctgatactcactgnggagagagccatacaattgatggccaaagacgggtttgggtgtcgggacggagggacctagctgaccgtcctagggcacgcccaggctcgcccctgtcacgctcgttccccaccgttcnccgctacgtacgacg

SEQ ID NO: 348084 - DNA, 592 bp, Homo sapiens
  misc_feature: GZ8MTXP02J1N0Z.15.86.H09.1.454.CMB.2.raw
  modified_base (538)..(538): a, c, t, g, unknown or other
  misc_feature (538)..(538): n is a, c, g, or t
  modified_base (547)..(547): a, c, t, g, unknown or other
  misc_feature (547)..(547): n is a, c, g, or t
  modified_base (558)..(558): a, c, t, g, unknown or other
  misc_feature (558)..(558): n is a, c, g, or t
  modified_base (569)..(569): a, c, t, g, unknown or other
  misc_feature (569)..(569): n is a, c, g, or t
  modified_base (576)..(576): a, c, t, g, unknown or other
  misc_feature (576)..(576): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcataccgaacctacaccatcgaatggtatacaacagagaccgaggaactcccccagtatataatagaaagtaagagtgatggcacgaccaacgaccggaaggggacggactccccgactcgctcgagtcggctccgagtcggtggctcgaccgctacctccacctactcctaccacctccgagtctacgacgtacgaggagtctagtagtactaccgagttaggacggaagacgacgaccaaactactaaagttgaagtccggacgtaaaggtcggggttggtacggtcggggacgacgggaccaggcgtacgcccgtacgagtcaccggaccgaggcccnccgtcccgngaccctcgtcnccgttaccccncgttccncgtaccgtacgactcg

SEQ ID NO: 348085 - DNA, 730 bp, Homo sapiens
  misc_feature: GZ8MTXP02IHBH8.15.86.H09.1.454.CMB.2.raw
  modified_base (313)..(313): a, c, t, g, unknown or other
  misc_feature (313)..(313): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacgccatcgaatggtatcaacagagaccgaggaacgtcccccagtactataatagaaagttagagtagatgacagccacgacggaaggggacggactcccgagtcnctcagtcggctacgtagtcgtcgggctacgacccgtacctacctccccaacctactccacccaacccgtccacgtcagtaccgagtacgacggtcgtagtaacgttacgttcaccggttagggagggaaacgaacggacaccccctttaaaagaacgttaagtacggacgtaaccgggtaaaccgggttaaacgggggttcgggggtttggggtaccggggtacgggggaaccgggtaaccgggaacctacggtccggttaacccggtccggttacggtaaccggtaccgaacccgggtaccggtaccggtccccgtacccccgggtacccccgttccgtaccccgttcccgttccccggttccccggttaacccccgtcccgttaccgtacccggtaccgttacggaccggtacgg

SEQ ID NO: 348086 - DNA, 551 bp, Homo sapiens
  misc_feature: GZ8MTXP02I552I.15.86.H09.1.454.CMB.2.raw
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacacgaaggggacggatccccgatcgcttcagtggctcagttcgtggggctgaccgctacctccaccactctaccactccagtctgacgatgagctgagtancacgtgngganaganccaanacaatgatcggaccaaggtacgggtttgggtcgtcgggacggtaggaccaaggctggacccgtgtaaggcacgccgaaggcctacgccccgtcgggtacaccgttcgtccggttccccgcctcccgtcgacttacggtagtaccgg

SEQ ID NO: 348087 - DNA, 618 bp, Homo sapiens
  misc_feature: GZ8MTXP02G5JIW.15.86.H09.1.454.CMB.2.raw
  modified_base (301)..(301): a, c, t, g, unknown or other
  misc_feature (301)..(301): n is a, c, g, or t
  modified_base (322)..(322): a, c, t, g, unknown or other
  misc_feature (322)..(322): n is a, c, g, or t
  modified_base (567)..(567): a, c, t, g, unknown or other
  misc_feature (567)..(567): n is a, c, g, or t
  modified_base (590)..(590): a, c, t, g, unknown or other
  misc_feature (590)..(590): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacagggaactcccccagtatataatagaaagttagagtgatggcagccaacgacggaaggggacggacncccgatcgctcagtggctcgngttcgtgggctcgaccgctactccacatcctaccacctccacgtctacgacgagtgagtctagagtatcgacgtggtacggagaacggacacccaacaacgtaagttacgaagttacgggaacccgtaaaagggttccgggggtttggggtacggttaccgggggaggggtaacgggacaaagggccgtacggtacccgtccgtaggccacggacccgaggtccctaccggcccccttggtaccnccggttcctccgtttaccccccnccgttccgacgtaccgtacggtacgacg

SEQ ID NO: 348088 - DNA, 652 bp, Homo sapiens
  misc_feature: GZ8MTXP02HPBQ1.15.86.H09.1.454.CMB.2.raw
  modified_base (302)..(302): a, c, t, g, unknown or other
  misc_feature (302)..(302): n is a, c, g, or t
  modified_base (417)..(417): a, c, t, g, unknown or other
  misc_feature (417)..(417): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttagagtgatggcagccacaccggaaggggacggacncccgatcgctcagtgggctcgagttcgtgggctcgaccgctacctccaccactcctaccaacctcccagtctgacgatgacgtctagagtatcacgttggaggagagacgccaanactaaagttgaacgtcgggaccgtaaagggtacggggttttggggtgggttaccgggggacgggaacggggaacccaagggtcccgtacgggtaccccgttacggtacgggtacccaacggaccccgtaaagggtccctcccgggtcccccgttacgggtcctacccgttccgttaaccccggtttccccaccccgtttcccgtaccggtaccgttaaaccggttacgaacccgg

SEQ ID NO: 348089 - DNA, 650 bp, Homo sapiens
  misc_feature: GZ8MTXP02HJ7K2.15.86.H09.1.454.CMB.2.raw
  modified_base (252)..(252): a, c, t, g, unknown or other
  misc_feature (252)..(252): n is a, c, g, or t
  modified_base (329)..(329): a, c, t, g, unknown or other
  misc_feature (329)..(329): n is a, c, g, or t
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
  modified_base (517)..(517): a, c, t, g, unknown or other
  misc_feature (517)..(517): n is a, c, g, or t
  modified_base (526)..(526): a, c, t, g, unknown or other
  misc_feature (526)..(526): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggccnccaggctcgagggaagggctggagtgggttggacgtttacaaaagtaaaatgatggtagaagaaaatagactacggngcacccgtagaaaaggagattacaccanctacaaganaataaattaaacaaaaaacgtacggtagttattagacaaaatagaaacacgacctaaagaaacccggagaaacacacgtaccgtactaactttaacctagtaaacccaacgaagtaacgttacggaaagtgactaagacgaaggtaaaagngactatgtnttttagattatcgtcggggacccaagggacaaagttcggtcgtctctcttacacgccctaaccaaccgaaacgggcccctaagtccgtaacccttcccccgagccacccctccaccaacggacg

SEQ ID NO: 348090 - DNA, 612 bp, Homo sapiens
  misc_feature: GZ8MTXP02GK77I.15.86.H09.1.454.CMB.2.raw
  modified_base (226)..(226): a, c, t, g, unknown or other
  misc_feature (226)..(226): n is a, c, g, or t
  modified_base (239)..(239): a, c, t, g, unknown or other
  misc_feature (239)..(239): n is a, c, g, or t
  modified_base (328)..(328): a, c, t, g, unknown or other
  misc_feature (328)..(328): n is a, c, g, or t
  modified_base (424)..(424): a, c, t, g, unknown or other
  misc_feature (424)..(424): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgccccgtctgcatctgccttgctgggagcctcgatcaagctcacctgcacctaagtagtgagcatcgaacctacaccatcgaatgtatcaanagagacgaggacnccccagtatataatagaaagttaagagtgatgcacgaccacgacggaaggggacggactccccgatcgctcgagtggctacgtagtcgnggggctcggaccgtacctacctaccacctactcctacccaacctccgagtcgtacgacatggagtctagagtatcagttggagagagacgaccaanacgtaatagagacggaccgaaagggtcggggttgggtcgtacgggggagtaaccggaacgacgtcgtacggacccgttacgacggacgacgtacccgaacgggtcctcccggcccccgtacggtaccaccgttcccgtccggttcccccgccctttcccgccggtaaccgtaccggtaacgtaccggg

SEQ ID NO: 348091 - DNA, 694 bp, Homo sapiens
  misc_feature: GZ8MTXP02HBHWP.15.86.H09.1.454.CMB.2.raw
  modified_base (363)..(363): a, c, t, g, unknown or other
  misc_feature (363)..(363): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgaggttgggtccgccaggctccgagggaagggctggagtgggtggacgttacaaaagtaaaatgatggtagaagaaaatagactacggtgacacccgtagaaaggaagatcacatctacaaganaataatacaaaaacgtacgtagtattcgacaaatagaacagacctaagaaaccgagaacaacgacgtaccgtactacttactacgtaacccaacgaagtacgttacggaaagttcgactaagtacgaaacggtaaaagggacggtacttaagtgttactttttagattaggtccgtacgggggacccgaagggtaacaaggttcggttaccgtcgtctttaccgttaccgaccgtcccctacccgaacccgaaccggggtacccctaacgttccccggttcccgttcccccgtcggaccccctaaccccgtccctacccgaaacgtacccg

SEQ ID NO: 348092 - DNA, 607 bp, Homo sapiens
  misc_feature: GZ8MTXP02FFJYK.15.86.H09.1.454.CMB.2.raw
  modified_base (252)..(252): a, c, t, g, unknown or other
  misc_feature (252)..(252): n is a, c, g, or t
  modified_base (273)..(273): a, c, t, g, unknown or other
  misc_feature (273)..(273): n is a, c, g, or t
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
  modified_base (318)..(318): a, c, t, g, unknown or other
  misc_feature (318)..(318): n is a, c, g, or t
  modified_base (331)..(331): a, c, t, g, unknown or other
  misc_feature (331)..(331): n is a, c, g, or t
  modified_base (367)..(367): a, c, t, g, unknown or other
  misc_feature (367)..(367): n is a, c, g, or t
  modified_base (397)..(397): a, c, t, g, unknown or other
  misc_feature (397)..(397): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtcncaggctcgagggagggctggngtgggtgattacaaaagtaaangatgganagaaatagactaggtncaccgtgaaaganatcacatctcaaagagataagttacaaaaacgcgtntattagacaaatgaacagacctagaaccgngaactacagcctatattactgtaaccacagtacttacggaagtagctagtacgacgtaaaaggngctangtctttagatagtcgtcggggacccagggaactaggtcggtcgttcgtactcgttacacgtccacccaccggaaaccggtcccaacgttccggtaacccttcccccggtacgacccctaccccccgtacaacgcgaccccg

SEQ ID NO: 348093 - DNA, 623 bp, Homo sapiens
  misc_feature: GZ8MTXP02IEYRR.15.86.H09.1.454.CMB.2.raw
tcagtctacgtagccacgaccggtgctcgatttagtgctatagacttgggtttggggggacttccctggtctccttctacctactgcccttcatttttctccacaggtctctgtgctctgcctgtgctgactcagcccccgtctgcatctgccttgctgggagcctcgatcaagctcacctgcaaccctaagtagtgagcatcgaacctacaccatcgaatgtatcaacagagacagggactccccagtaatataatagaaagttaagagtgatggcagaccacgaccgaaggggacggactccccgatcgcttcagtggctccgtaggttcgtggggctacggacccgtacctacctcccaacccacttccctacccctaacccgtcccagttcctggaacgagtggacggctaggatactcgacgttggaggagaagacgacctaacaactaagttgagtacggaccgtaaagggtcgggggtttgggtacgggttacggggacgggacggaaccgaaggtcgtcggtaacccgtctacgggcacggcccaggcctacccgccccgtcgcctaccgttctccgttcccccaccttccgacgccgttaacggacggtacggg

SEQ ID NO: 348094 - DNA, 660 bp, Homo sapiens
  misc_feature: GZ8MTXP02HE3X2.15.86.H09.1.454.CMB.2.raw
  modified_base (331)..(331): a, c, t, g, unknown or other
  misc_feature (331)..(331): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccacgggaacgtcccccagtatataatagaaagtaagagtgatggcagccacgaccgaaggggaccggatccccgatcgcttcagtggctcagttcgngggctcgaccgctacctccaccatacctacccaacctccacgtcgtacgacgtacgtagacggtctagggaattactcgtaaacggttgcgggaagacgacgaccctacaaacgtaagttacggaactagggtaacccgtaaagggttaccggggtttaggggtacgggtttaccggggaacggggtaacggaaccgaagggtaccgtcggtacccggtacgtacgggaccgacggaccccgtaaggggccctacccgcccccgttcggaacctccgtcccgttccgtcccccgtcccgtcccttacggacccttacggtaacgtccgg

SEQ ID NO: 348095 - DNA, 639 bp, Homo sapiens
  misc_feature: GZ8MTXP02FJ3WV.15.86.H09.1.454.CMB.2.raw
  modified_base (279)..(279): a, c, t, g, unknown or other
  misc_feature (279)..(279): n is a, c, g, or t
  modified_base (359)..(359): a, c, t, g, unknown or other
  misc_feature (359)..(359): n is a, c, g, or t
  modified_base (435)..(435): a, c, t, g, unknown or other
  misc_feature (435)..(435): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccaggaacgtcccccagtatataatagaaagtaagagtgatggcanccaacgaaccggaagggggacggactccccgagtcgcttacagtcgggcctccgagttcgtggggctcgaccgcttaccncccaccactctacccaacctccagtcgtgaaccgtagtaggagtcgtagagtactcaacgttggaggaagagaacnccaaacgactaagttgaacgtggaccgaaagggtcgggttggggtacggttacggggacggggaacgggaaccgaaacggcgttaacgacccgggttacgttacgcgaaccggcccgaaacggcctaccggcccccgttcggtccaccgtttccgtccgttacccccgcccgttccctacgtacccgtaaggtacccgtaacgg

SEQ ID NO: 348096 - DNA, 668 bp, Homo sapiens
  misc_feature: GZ8MTXP02JLE5W.15.86.H09.1.454.CMB.2.raw
  modified_base (350)..(350): a, c, t, g, unknown or other
  misc_feature (350)..(350): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgaggggagggctggaggtgggttggacgtttacaaaagtaaaatgatggtagaagaaaatagactacggtgcgacccgtagaaaggaanattacacatctacaagagataattacaaaacgtacgtagttatttacgacaaatagaaacacgacctaacgaaaccggagaaccaacgacgccgtactattactacgtaccaacagtacgttacggaagtagcacgtacgaacggtaaaggaggtactattggttctttagattacgtcggtcggggacccgaggggactaacgtgggttacgtcgtacttcgtacgcgtcccctaccgaaccggtaccggccctcgttcccggtccccgtttcccccggtacgtaccccctacccctccgtacccgaacggtacccg

SEQ ID NO: 348097 - DNA, 673 bp, Homo sapiens
  misc_feature: GZ8MTXP02J2FDO.15.86.H09.1.454.CMB.2.raw
  modified_base (232)..(232): a, c, t, g, unknown or other
  misc_feature (232)..(232): n is a, c, g, or t
  modified_base (252)..(252): a, c, t, g, unknown or other
  misc_feature (252)..(252): n is a, c, g, or t
  modified_base (365)..(365): a, c, t, g, unknown or other
  misc_feature (365)..(365): n is a, c, g, or t
  modified_base (383)..(383): a, c, t, g, unknown or other
  misc_feature (383)..(383): n is a, c, g, or t
  modified_base (400)..(400): a, c, t, g, unknown or other
  misc_feature (400)..(400): n is a, c, g, or t
  modified_base (415)..(415): a, c, t, g, unknown or other
  misc_feature (415)..(415): n is a, c, g, or t
tcagtctacgtagccacgaccggtgctcgatttagtgctatagacttgggtttggggggaagaggaagactgacggtccccccaggagttcgggctgagctgggtttccttgctgctatcttaaaaggtgtccagtgtgaagtgcaggtggtggagtctggggggagccttggtaaagcctggggggtcccttagagtctcctgtgtggcctctggattcactttcagtaanggctggatgagttgggtccnccaggctccgaggggaaggggctgggagtggggttggacgtttacaaaagtaaaatgatggtagaagaaatagactaggtgcaccgtgaaaggagattcaccatctacaaganataatacaaaaacgcgtntattgactaatgaaacngccctaagaacccgnggaacctacgagtcccgtacttaattaccacgtaacccagagtagttacggaatgacctagttacgaaacggtaaaggcggtaccttaagtggtacttttaggattaagtccgttacgggggacccttaaggggaacctaagttcgggtaccgttccgtactttccgttacgaccgtcccgtaccgaaccccgaggggaccccctgttaccccgggtcccttcccccgtacggccctacccctccgaaccagggaccc

SEQ ID NO: 348098 - DNA, 679 bp, Homo sapiens
  misc_feature: GZ8MTXP02GVDG3.15.86.H09.1.454.CMB.2.raw
  modified_base (366)..(366): a, c, t, g, unknown or other
  misc_feature (366)..(366): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgaggttggtccgcgaggctccgaggggagggctggagtgggttgacgtttacaaaagtaaaatgatggtagaagaaatagactaacggtgaccaccgtagaaaggagattcacatctacgaaganaataatacgaaaaacgtcgtagttattacgacaaatagaaacacgacctaagaaccggagaacacgacgtccgtataacttactcgtaaccaacgagtacgttacggaagtcgaccataccggaaaggttaaaggcggtacttagtgttcttttagaacttcggtaccggccggggaccaaggggactaggttcggtcgtacgttccttcttaccgacgtaccccctacgaaacccggacgggtccccctaaggttccccggtccccctttacccccgcggacccctaccccgttccaaccggaacgtacccg

SEQ ID NO: 348099 - DNA, 713 bp, Homo sapiens
  misc_feature: GZ8MTXP02GY9ZW.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaaccgaaggggacggactccccgatcgcttcgagtggcctccagttcgtggggctcgaccgcctacctcccaccactcctacccaacctccagtctagacgatgaggctagagtatcgacgtggaggagagacgcccaacaactaaagttcgaagtacgggaaccctaaaggggtacggggtttgggggtacggtttacgggggacggggaaaccggggtaaccaaagggtccgtacgggtaaccccgttacccgttaacgggggtacccaaccgggacccccggtaaaagggtccccgtaccccggggtaccccccccgttggggttaccccctaacccgtttcccggtaaccccccggtttccccccggtccccctttaacccccggtccgtaaccccggtttaaccgggttaaaccggtaaccgg

SEQ ID NO: 348100 - DNA, 757 bp, Homo sapiens
  misc_feature: GZ8MTXP02GMZIM.15.86.H09.1.454.CMB.2.raw
  modified_base (376)..(376): a, c, t, g, unknown or other
  misc_feature (376)..(376): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcacctaagtagtgagcatcgaaacctacaccatacgaatggtatacaagagacgacgagggacctccccagtatataatgaaagttagagtgagtggacagccaacgaccggaaggggacgacgtccccgatccgtactacgagtacgggcctaccgtggttcgtcggggtctcggacctacttaccaccaacctnttaccaaccctaacctcctacgttaccgtggaaacgtagtacgaaccgggttactagtaacgtactacgtaacggtaggaaggaacgtaacgacctaaacccgaaacgtaagtaacgtacgtaacggtaacggtaacggtaaacgggtacggggttacggggttacggggttaccggggtaaccggggtaaaccgggaaccggtaacggtaccggtaaccggtaacccggtaacccggtaacggtaaccggtaacccggtaacccggaaccggtacccggtaccccggtaccccggtacccggtacccgtacccgttacccgttaaccccggttccccgtaccccgttacccgtaccgtaccgttaaccggtacggtacgg

SEQ ID NO: 348101 - DNA, 623 bp, Homo sapiens
  misc_feature: GZ8MTXP02GNFM1.15.86.H09.1.454.CMB.2.raw
  modified_base (281)..(281): a, c, t, g, unknown or other
  misc_feature (281)..(281): n is a, c, g, or t
  modified_base (341)..(341): a, c, t, g, unknown or other
  misc_feature (341)..(341): n is a, c, g, or t
  modified_base (388)..(388): a, c, t, g, unknown or other
  misc_feature (388)..(388): n is a, c, g, or t
  modified_base (408)..(408): a, c, t, g, unknown or other
  misc_feature (408)..(408): n is a, c, g, or t
  modified_base (592)..(592): a, c, t, g, unknown or other
  misc_feature (592)..(592): n is a, c, g, or t
tcagtctacgtagccacgaccggtgctcgatttagtgctatagacttggggtttggggggacttccctggtctccttctacctactgcccttcatttttctccacaggtctctgtgctctgcctgtgctgactcagcccccgtctgcatctgccttgcgtgggagcctcgatcaagctcacctgccaccctaagtagtgagcatcgaacctacaccatcgaatggtatacaacagacgacgacgggaaccgtccccagtaatataatagaaagtagagtanagtgacagaccacgacggaaggggacggactcccgatcgctcagtcggctcgagttcggngggctacgaccgcctacctcccacctactccacctacctcctagtcngacgagtgagactggatacncgagtgagaagagtacgaccaacgtactaagttagacgttacgggaaccgtaaagggttcggggtttagggggtcggtacgggggacgggtaacggacgaaggccgtaccggacgtacgtacggccgacgtacccggaaggtccctcggcccccttcggacctccgtccgtccccgttcccccncccgttcccgagtaccgttacggacgtacgg

SEQ ID NO: 348102 - DNA, 634 bp, Homo sapiens
  misc_feature: GZ8MTXP02H4BT3.15.86.H09.1.454.CMB.2.raw
  modified_base (428)..(428): a, c, t, g, unknown or other
  misc_feature (428)..(428): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagtaagagtgatggcagccaacgaccgaaggggacggactccccgatcgcttcagtcgggctccgagttcgtggggctcgaccgctacctcccaccactcctacccaacctccaacgtctagacgatgaagctagagtactcacgttggaggagagacgtccaanacgtaaattgatcggaccgaaagggtcggggtttgggtacgggtcggggacgggaacggacccaaggtccgtaggtaaccccgttacgtacgggtaccgaaccggccccggtaaagggtccctacccggacccccgttcgggtaccctaccgttccgttcgttcccccgtccccgttcccgtacgtacccgttacggtaacgccgg

SEQ ID NO: 348103 - DNA, 880 bp, Homo sapiens
  misc_feature: GZ8MTXP02HAGUF.15.86.H09.1.454.CMB.2.raw
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttggtccgccaggctcgagggagggctggagtgggtgacgtttacaaaagtaaatgatggtagaagaaatagactacggtagccgaacccgtagaaaggaagtacttacacctagtctaacgaagagtaaacttaattaaaccgaaaaacggtacggttagttaacttttaggaacctaaaagttacgaaacgtacgtaacccgttaaacggaaacccgggaacgggtaaaccaaccgtaacggtaccccgtttactttaaaccgtttaccgtaaccggttaaaccccaaacgtaaacgggttacgtttaacccggggaaaagttgtaaccccgtaaggtttaaccccgggaaagggttaaaaacggggacggttattaacgtttcgggttacctttttaggaaacctttacgggtacccggttaccgggggaaccccgttaaagggggaacccttaaggggttcccgggtttaccggttcccgttacctttaaccgttccgaacccggtaccccttacccccggaaacggtaaccccgggtccccctaaacggtttccccggggttcccccttttacccccccggacggttacccccctaccccccgtttcccgtaaacccccgaaaggttccccg

SEQ ID NO: 348104 - DNA, 622 bp, Homo sapiens
  misc_feature: GZ8MTXP02HOQCP.15.86.H09.1.454.CMB.2.raw
  modified_base (275)..(275): a, c, t, g, unknown or other
  misc_feature (275)..(275): n is a, c, g, or t
  modified_base (345)..(345): a, c, t, g, unknown or other
  misc_feature (345)..(345): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatacaacagagaccagggaacgccccccagtataataatagaaagttaagagngatggcacgccaacgaccgaaggggacggactccccgagtcgctcagtcgggctccgagtcgtggggtcngtaccgctacctccgaccactccaccaacctccacgtcctacgacacgtgagctagacgtactcacgtgtggaagagacgaccaactaacgaaagttgagtacgggacccgtaaaggtccggggtttagggcggttacgggggacgtaacggggacctaaaggcctcggaaaccgtccgtaaggcccaacggaccccgaaggtcccgtaccgcccccgtacggtcctaacccgttctaacccgtccccacccttcgaccgtacgtaacggtacgacg

SEQ ID NO: 348105 - DNA, 592 bp, Homo sapiens
  misc_feature: GZ8MTXP02J0LDA.15.86.H09.1.454.CMB.2.raw
  modified_base (381)..(381): a, c, t, g, unknown or other
  misc_feature (381)..(381): n is a, c, g, or t
  modified_base (411)..(411): a, c, t, g, unknown or other
  misc_feature (411)..(411): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
  modified_base (465)..(465): a, c, t, g, unknown or other
  misc_feature (465)..(465): n is a, c, g, or t
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtggggttggacgtttacaaaagtaaaatgatggtgagaaatgactacggtgcacccgtgaaaggagattcaccatctacaagagataatacaaaaacgacggtntatttcgacaatgaacagacctagaaccgngacacagccgtactattacngtaccanagattcggaatgcatcgaacgtaaggngctatgctttgatatcgtggggcccagggactagtggtactcgtctacttcacgcccctacgaacccgtacgggccctacgtccggttccccttccccgtcggacccctaccctcctaccgacgccg

SEQ ID NO: 348106 - DNA, 626 bp, Homo sapiens
  misc_feature: GZ8MTXP02F5920.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggacgtccccagtatataatagaaagttaagagtgatggcagccacgaccgaaggggacggactccccgatcgctcagtgggctccgagttcgcggggtctcgaccgctacctcccaccactcctacccaaccgtccagtcgtgacgatgagctagagtactcgaacgtggtagggagagacgccctaaagactaagttgagttcgggaccgtaaagggtcggggtttggggtcggttcgggggacggaacggggaccaaggtccgtacggaacccgttcgtaagggtccacggaccccgtaaggccccgttccgccccccgttagggtccctaaccgtttccgtaaccgttacccccaccgttccgtacgtaccgtacgtacgtacgg

SEQ ID NO: 348107 - DNA, 711 bp, Homo sapiens
  misc_feature: GZ8MTXP02FZB5F.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgccaccctaagtagtgagcatcgaacctacaccatcgaatggtatacaacagagaccgagggactccccagtatataatagaaagttaagagtgatggacagccaacgaccggaagggggacggactccccgatcgctcagtcggctcgtagttcgtggggctcgaccgtcctacctacccaccactcctacccaccctccacgtcgtgacgagtaggacgtcgtagtagttactaccgtacggttggacgggaaagacgacgaccccaaataacgtaaacgttcggaagttaccggggaaacccgtaaagggggtaccgggggttttggggtacgggttacccgggggacggggtaaaccgggacccgaagggtcccggtacggaaccccgggttcgtaacggtacccggaaccggtcccccggaaaggtccccgttaccccggaccccccgttcggtacccctccggttccctaaccccggttacccccctaccgtccccgtaccggaccgttaccggtacgtaccggg

SEQ ID NO: 348108 - DNA, 636 bp, Homo sapiens
  misc_feature: GZ8MTXP02HDAPG.15.86.H09.1.454.CMB.2.raw
  modified_base (329)..(329): a, c, t, g, unknown or other
  misc_feature (329)..(329): n is a, c, g, or t
  modified_base (344)..(344): a, c, t, g, unknown or other
  misc_feature (344)..(344): n is a, c, g, or t
  modified_base (424)..(424): a, c, t, g, unknown or other
  misc_feature (424)..(424): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggactccccgatcgctcagtggctcgagtcgngggctgaccgctacncccaccatcctaccaacctccagtcctagacgagtgaacggtctaggtatatcgacgtggtagggataaggacacccaanaaactaaagtttggaacttagggacccgtaaaaggggtccggggttttggggtacggttccgggggaacgggaacggggaaaccctaagggtcctacggggtaccctacccgttagggacccgacggaccccgaaagggtccctaccggccccccgttggtaccctacgtccgttccgtaccccgcctccgtacgtcctaacggtacgccgg

SEQ ID NO: 348109 - DNA, 824 bp, Homo sapiens
  misc_feature: GZ8MTXP02HOKHC.15.86.H09.1.454.CMB.2.raw
  modified_base (228)..(228): a, c, t, g, unknown or other
  misc_feature (228)..(228): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaanagagaccgaaggaacgtcccccagtatataatagaaagttagagtgatggacacgaccacgacggaagggggacggactccccgatcgctcagtcggctcgtagtcgtgggctcgaccgtcctaccacccacctactccctaccaacctccgaacgtctacgacgtagtacggacggtcgtaggtataactccgtaacggttaggggacggaaagggttacggaaccacccccgtaaaactaaacgggttaaaatttccggaaggttacccgggaaacccggaaaagggggtttacccgggggtttttggggggtaaacgggttccccgggggaaacccgggggtaaaggggtaaaacccccgaagggttccccgtaaccggggttacccccggttacccggtaaagggggtacccaaacccggtaccccgggttaaacgggggccccttaaaccccccgggtacccccccggtttaccgggtaacccttacccccgttttcccgggttaaccccccgggttaccccccccttaaacccccggtacccccggttccggttaccccggtttaaaaaccgggtaccggtaccccgggg

SEQ ID NO: 348110 - DNA, 628 bp, Homo sapiens
  misc_feature: GZ8MTXP02IGC9Y.15.86.H09.1.454.CMB.2.raw
  modified_base (395)..(395): a, c, t, g, unknown or other
  misc_feature (395)..(395): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacagggaactcccccagtaatataatagaaagttaagagtgatggcagccacacgaaggggacggactcccgatcgctcagtggctccagttcgtggggctcgaccgtcacctcccaaccactcctccaaccctccagtcctgacgatgagcgtagagttacncacgtgtgggagagacgccaacaactaagttagagacgggaaccgaaaggtaccggggtttggggtcgggttaccggggacggggtacgggaaccgtaaggccgtacggacccgttacgtagggtaccacggacccgaacggtctcccggtccccgtcgggtaccctaccgttccgtcccgtttacccccgaccccctttcccgtaccggtccgttaacggtaacgttaccgg

SEQ ID NO: 348111 - DNA, 689 bp, Homo sapiens
  misc_feature: GZ8MTXP02GC4R9.15.86.H09.1.454.CMB.2.raw
  modified_base (300)..(300): a, c, t, g, unknown or other
  misc_feature (300)..(300): n is a, c, g, or t
  modified_base (476)..(476): a, c, t, g, unknown or other
  misc_feature (476)..(476): n is a, c, g, or t
  modified_base (517)..(517): a, c, t, g, unknown or other
  misc_feature (517)..(517): n is a, c, g, or t
  modified_base (530)..(530): a, c, t, g, unknown or other
  misc_feature (530)..(530): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctggggggagccttggtaaagccgtggggggtcccttagagtctcctgtgtggcctctggattcactttcagtaatggctggatgagttgggtccgcaggctcgagggagggctggagtgggtgacgttacaaaagtaaaangatggtagaagaaaatagactacggtagccaaccgtagaaaaggagtattaccaacgatctacaaagtacgaattaaattaacaaaaaacgtacggtagttaatttacgaactaaatagaaacagacctaagaaacccgaggaactacacgtccgtataattacctagtacccaanagtattacgggaaagtgacagtaaccggaaaggtaaaaggngtacttagtgttntttagattacggtcgacggggaccgaaggactaagtcggtaccgtcgttctcgtaccaccgtaccctaccgaaaccggtaaccggtaccctaacgttcccggttaaccccgttcccccggacggtaccccctaacccctaccgtaacccgaacgtaccg

SEQ ID NO: 348112 - DNA, 706 bp, Homo sapiens
  misc_feature: GZ8MTXP02FLGOD.15.86.H09.1.454.CMB.2.raw
  modified_base (428)..(428): a, c, t, g, unknown or other
  misc_feature (428)..(428): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccaggacgtccccagtatataatagaaagttagagtgatgcagcacacggaaggggacggactccccgatcgtctcgagtcggctccgtagtcgtggggctcgaccgtcctaccaccacctactcctaccaaccctccacgtctacggacgtagtacggaggtctagtagtactacgtaaccgtgggtagggaanacggaacgtacccaacaacgtaaacgttagaaggttccggaaccggtaacggggtaacgggggtttcgggggtacggtttaccgggggacgggaacggggaaccgtacggcggtacggtacccggtaaccgtacgggtacccgaacggaccccggtaaagggccccttaccgggccccccccgtaggttacccccgtaccgtttacccggttcccgttcccccccgtacccccggttcccgttaacccgggtaccttaaccgggttaccgtaaccggg

SEQ ID NO: 348113 - DNA, 583 bp, Homo sapiens
  misc_feature: GZ8MTXP02G51FM.15.86.H09.1.454.CMB.2.raw
  modified_base (228)..(228): a, c, t, g, unknown or other
  misc_feature (228)..(228): n is a, c, g, or t
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
  modified_base (302)..(302): a, c, t, g, unknown or other
  misc_feature (302)..(302): n is a, c, g, or t
  modified_base (310)..(310): a, c, t, g, unknown or other
  misc_feature (310)..(310): n is a, c, g, or t
  modified_base (327)..(327): a, c, t, g, unknown or other
  misc_feature (327)..(327): n is a, c, g, or t
  modified_base (339)..(339): a, c, t, g, unknown or other
  misc_feature (339)..(339): n is a, c, g, or t
  modified_base (451)..(451): a, c, t, g, unknown or other
  misc_feature (451)..(451): n is a, c, g, or t
  modified_base (510)..(510): a, c, t, g, unknown or other
  misc_feature (510)..(510): n is a, c, g, or t
  modified_base (534)..(534): a, c, t, g, unknown or other
  misc_feature (534)..(534): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgcgtgggagcctcgatcaagctcacctgcaccctaagtagtgagcatcgaacctacaccatcgaatgtatacaanagaacgacgaggaacgtaccccagtatataanagaaagttagagngangcancacgacgaggggacganccgancgctcagnggctcgtagtcgtggcncgacgtctaccncctaccactcctaccaacctcagtctcgagtagtcgagcagtatactacgacgttggaagagaacgctaccaacaactaagttcgagacggaccgtaaaggtcgggttgggnggtccggggagggacggaaacacggtcgacggtcccggtaagtcgacacggtaaaccgnggccttaccggccccctaggtccnccgttccgtccgtcccctacccttaccgcgtaccgtactaacggaccgg

SEQ ID NO: 348114 - DNA, 653 bp, Homo sapiens
  misc_feature: GZ8MTXP02HFSD2.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatccgaacctacaccatacgaatggtatacaacagagatcgagggactccccagtatataatagaaagtaagagtgatggacagaccaacgacggaaggggacggactccgatcgctcagtcggctcgtagttcgtgggctacgaccgtcctaccccgcctaccactcctaccaaccctctcgtctagaccgtatggacgcgtaggtatactaccgagtggtaggaacgagaccgaccaacgaactagttcggaacgttacggggaacctaaggggtttccgggggttgggtttaccggggcggggaacggggaggaacctaacgggtcgtccggtaaaccgttccggaacggtccgaaccgtacccggacggtccctttcccgggcccccgtagggtcctaccttccccggtaccctacccccgccgtttccgaccgtaccgtttagaacccggg

SEQ ID NO: 348115 - DNA, 689 bp, Homo sapiens
  misc_feature: GZ8MTXP02JGT45.15.86.H09.1.454.CMB.2.raw
  modified_base (226)..(226): a, c, t, g, unknown or other
  misc_feature (226)..(226): n is a, c, g, or t
  modified_base (390)..(390): a, c, t, g, unknown or other
  misc_feature (390)..(390): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacacatcgaatgtatcaanagagacaggaacgtccccagtatataatagaaagttaagagtgatggcacgaccaacgaccggaaggggaccggacgtaccccgatcgctcgagtggctccgagttcgtgggctcgaccgctacctccaccactcctaccaacctcctagtctacgacgtacgngaggctacgtagtactcgaacgtgggaagaggaacgacgtacccaagaacgtaagttcggacgtacggggacccgtaaaggggttaccgggggtttggggtacgggttccgggggaacggaaccggggtaaccgaaggttcccgtacggtacccgggttaccggtaacggtaccgaaacccgggtcccgtaaacgggcccccgttacccgggcccccggtttcgaacccccgtttcgtacccccgtttccggttccccccggcctttcccggaccgtacgttaaccggtacgtaaccgg

SEQ ID NO: 348116 - DNA, 591 bp, Homo sapiens
  misc_feature: GZ8MTXP02FEQYS.15.86.H09.1.454.CMB.2.raw
  modified_base (353)..(353): a, c, t, g, unknown or other
  misc_feature (353)..(353): n is a, c, g, or t
  modified_base (379)..(379): a, c, t, g, unknown or other
  misc_feature (379)..(379): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgagtggcagccacaccgaaggggacggactccccgatcgcttcagtgggctcctaggtcgtggggctcgaccgcctaccncccaccatctccaaccctcacgttcngacgagtgaggtctaggatatcacgttggaggagacgacgcctaacaactaattgacgtaggaccgaaagggtccggggttggggttacgttcggggacgggacggaaccaagcgtcgaccgttcgtagtcgaccgaccaaagggtcctccgcccccgtcgtacctacctcgtcccgtccctaccccgtccgtaccgtacgaacgtcgaacg

SEQ ID NO: 348117 - DNA, 627 bp, Homo sapiens
  misc_feature: GZ8MTXP02IE6N9.15.86.H09.1.454.CMB.2.raw
  modified_base (449)..(449): a, c, t, g, unknown or other
  misc_feature (449)..(449): n is a, c, g, or t
  modified_base (608)..(608): a, c, t, g, unknown or other
  misc_feature (608)..(608): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaaacagagaccagggaacgtcccccagtatataatagaaagttaagagtagatggacagaccacaaccgaagggggacgggacgtaccccgacgtcgcttcagtgggctccgtagttcgtggggctcgaccgcctacctaccaccactcctaccaacctccacgtcgttagaacgatagaggtcgtagtacgtatacacgtggtaaggacgaagacgacccaanaacgaaagttcgatcgggaccaaaggtacggggtttgggagttcgggagggacgggaaccaagcgtcggaaccgtccgtagggtaccacggacccgaagggtcctcccggacccccgtcggtccctaccgtccgttccggttacccccacccgtttccnccgtcgtacggttaacgcg

SEQ ID NO: 348118 - DNA, 555 bp, Homo sapiens
  misc_feature: GZ8MTXP02FF87B.15.86.H09.1.454.CMB.2.raw
  modified_base (309)..(309): a, c, t, g, unknown or other
  misc_feature (309)..(309): n is a, c, g, or t
  modified_base (329)..(329): a, c, t, g, unknown or other
  misc_feature (329)..(329): n is a, c, g, or t
  modified_base (356)..(356): a, c, t, g, unknown or other
  misc_feature (356)..(356): n is a, c, g, or t
  modified_base (392)..(392): a, c, t, g, unknown or other
  misc_feature (392)..(392): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacaccgaaggggacggatccccgancgctcatgggctccagtcgnggggctgaccgctacctcccaccatcnccaacctccagtctgacatgagctgagtatcgatgngagagagccacaacattgagtggaccaaaggtcgggttagggtcggttacgggggaggacggggaccaaggcgtcggacccgtcgttaggccagccccgaaggcctcgcccccgtacggtccacgttctccgtccccaccgttccaccgtactacgagtaccg

SEQ ID NO: 348119 - DNA, 602 bp, Homo sapiens
  misc_feature: GZ8MTXP02FLSAF.15.86.H09.1.454.CMB.2.raw
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
  modified_base (402)..(402): a, c, t, g, unknown or other
  misc_feature (402)..(402): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaaggggacggatccccgatcgctcatggctcgagttcgnggggcncgaccgctacctcccaccgactctaccacctccagtcctgacgatgagtctagagtatcaacgttggnggaacgtagacgccaaacgacgtagttacgagtacggaccgtaaaggtacgggggtttgggtcgggttacggggacgggtacgggaccaaggcgttgacccgtcgtaggcacgcccgtaagggcccttcgcccccgttacggccctaaccgttccgtaacccgttccccctaccctcgttccgaccgttacgtacgacgg

SEQ ID NO: 348120 - DNA, 822 bp, Homo sapiens
  misc_feature: GZ8MTXP02GL4KC.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgcgtgggagcctcgatcaagctcacctgaccaacctaagtagtgagcatacgaacctacacatcgaatggtatacaacagagaccgaggaacctaccccagtataataatagaaagttaagagtgagtcggacacgaccgaacgaaccgggaagggggaaccggtacgtaccccgagtcgtcttacgtagtcgggacctcgtacggttcggcgggtctacgaccgtacctacctaccccaacctactacctacccaaccgtaccacgttcgtacggaacgtagtacggacgggtactagggaattacgtaccgtaaggtgggtaacgggaaagacggttaaccgaccctaaaactaaagttaaagttgggaaacgtaccgggggaaaccgtaaaagggggtttcgggggtttcgggggtttacggggtaaccgggggaacggggaaaaaccgggggtaacccaaacgggtttcccggaaaccggggttacccgtttacccgggtaaaaggggccccgaaaaccgggtacccccggaacgggttccccgttacccccgggggtacccccttacgggttacccctaacccgtttcccccgggttaacccgtttcccccccgtaaacccttccgggtaaccctaccggttaaacgggtaactcccggggg

SEQ ID NO: 348121 - DNA, 623 bp, Homo sapiens
  misc_feature: GZ8MTXP02FL6B4.15.86.H09.1.454.CMB.2.raw
  modified_base (323)..(323): a, c, t, g, unknown or other
  misc_feature (323)..(323): n is a, c, g, or t
  modified_base (355)..(355): a, c, t, g, unknown or other
  misc_feature (355)..(355): n is a, c, g, or t
  modified_base (407)..(407): a, c, t, g, unknown or other
  misc_feature (407)..(407): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctggggggagccttggtaaagcctggggggtcccttagagtctcctgtgtggcctctggattcactttcagtaatggctggatgagttgggtccgccaggctcgagggagggctggagtgggtgacgttacaaaagtaaatgatgagaagaaatagactacggtnaccaccgtagaaagagatcaccatcacaaganataatacaaaagcgtatattgacaatgaacagacctaagaaccgagaccaanacgcctactatacgtacaccaactagtattacggaaatggacagtacgaaacggtaaaggagtactatcgttactttgatttacgtcggtcggggacccgaaggacgtaggcggttaccgtcgttacctcgttccagtcccctaccgaacccgacggggtacccacgttcccggtccctccccctcggtaccccaccccgttccaacccgagaccg

SEQ ID NO: 348122 - DNA, 699 bp, Homo sapiens
  misc_feature: GZ8MTXP02JNME7.15.86.H09.1.454.CMB.2.raw
  modified_base (323)..(323): a, c, t, g, unknown or other
  misc_feature (323)..(323): n is a, c, g, or t
  modified_base (351)..(351): a, c, t, g, unknown or other
  misc_feature (351)..(351): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgcgtgggagcctcgatcaagctcacctgcaccctaagtagtgagcatcgaacctacaccatacgaatggtaatcaacagacgaccgagggaacgtcccccagtactataagtagtaaagttaagagtagatggcagccacgaccggaggggacggctccgatcgctacngtcggctcgtagttcgtgggctacgccnctccacccacactacctaccacctcctagtcctcggaacgtagtacggacgtacgtgtaagtcgtaccgtaggttaggagggaacggacacgaccctaaaccgtaaagtaacgtttcgaagttacccggggacgttaaaacgggggtcggggttttagggggtaactccgggtaaggggacccgggaaacggggtacccaaacgggtccgtaaccggtaaccccggggtttcaaacggggcccaaaacggtccccgaaacggggtccctacccgtttacccccgggtcgtacccgtccgtcccgttaccccgtacccctacccgtacgtaccgtaccggtacgtacgg

SEQ ID NO: 348123 - DNA, 606 bp, Homo sapiens
  misc_feature: GZ8MTXP02FTWOA.15.86.H09.1.454.CMB.2.raw
  modified_base (381)..(381): a, c, t, g, unknown or other
  misc_feature (381)..(381): n is a, c, g, or t
  modified_base (549)..(549): a, c, t, g, unknown or other
  misc_feature (549)..(549): n is a, c, g, or t
  modified_base (554)..(554): a, c, t, g, unknown or other
  misc_feature (554)..(554): n is a, c, g, or t
  modified_base (589)..(589): a, c, t, g, unknown or other
  misc_feature (589)..(589): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcacttttcagtaatggctggatgagttgggtccgccaggctccgagggagggctggagtgggtgacgttacaaaagtaaatgatggtagaagaaaatgactacggtgaccaccgtagaaaggagattacaccatctacaagagataattacgaaaaacgnggtagtattagacaaatagaacacgacctagaaccgagacacacgtcctagtacttactagtaccaacagtagttacggaagttcgactagtaccggaacgtaaaagggcggtactagttgttactttagatacgtcgtcggggaccagggactagtcggtcgtcgtntcctnacgccctacaccgtacgccagtccgtccgttcccngcccaccctcacacgcg

SEQ ID NO: 348124 - DNA, 737 bp, Homo sapiens
  misc_feature: GZ8MTXP02G4OIJ.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccgaggaactcccccagtatataatagaaagttaagagtgatggcagccacgaccggaaggggacggactccccgatcgcttcagtcggctccgagttcgtggggctcgacccgctacctccaccactcctacccaacctccagtccgtcgacgagtaggaaggtcgtaggtaacgtactccgtaacgttggggtaagggaaagacggaccgacccaaaacgtaaaccttaagttacggaacgttacggggacccgtaaaagggggttccgggggtttgggggtacggggttccgggggaaccggggaaacgggggaacccctaaagggtcccggttacggtacccccggttacggtacggggtaccccgaacggacccccggaaacggggtcccccgttccccggtacccccccggtacgggttcccctaacccttcccgttaaccccggttaaccccccctaccgttcccgtaccggtaccgtaaccgggttacgacccggg

SEQ ID NO: 348125 - DNA, 639 bp, Homo sapiens
  misc_feature: GZ8MTXP02JPBJE.15.86.H09.1.454.CMB.2.raw
  modified_base (280)..(280): a, c, t, g, unknown or other
  misc_feature (280)..(280): n is a, c, g, or t
  modified_base (582)..(582): a, c, t, g, unknown or other
  misc_feature (582)..(582): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatacgaacctacaccatacgaatggtatacaacagacgaccgagggacgtcccccagtatataatagaaagttagagtgangcacgacacgacggaaggggacggactcccgagtcgctcagtggctcgtgttcgtgggctcgaccgtcctacctcccacctactccgtacctacctcacgtcgtagacgagttgagtcgtaggacttatccgtaaggtgggaacggacgaaggtaccaccaacaagtaagttcgagtacgggaccgtaaaggggttgggggtttggggtacggttacgggggacggaacgggaccaagggtcctacgggtaccgtacgtacggcctacggaccgacggcctaccccggccccgttcgtaccnccgttcccgttaaccgtcccccctaccgtccgtacgtaccgtttacgacgtccgggg

SEQ ID NO: 348126 - DNA, 666 bp, Homo sapiens
  misc_feature: GZ8MTXP02JKNNC.15.86.H09.1.454.CMB.2.raw
  modified_base (591)..(591): a, c, t, g, unknown or other
  misc_feature (591)..(591): n is a, c, g, or t
  modified_base (618)..(618): a, c, t, g, unknown or other
  misc_feature (618)..(618): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttaggtaaagccgtgggggtcccttagagtctcctgtgtggcctctggattctacttcagtatggctggatgaggttcgggtccgccgaggcctcggaaggggaggggctgggaggtggggttggtaacgtttaacgaaaaagttaaaagtgtaagtggtagaaagtaaaacgtagacgtacggtcgaccgaaccggtaggaaaaggagtataccactatcacaaagagtaaataaactaacgaaaacgtcggtattagttacgaacaaagtacgaacacggaccctaaaggaaaaccccgagaccaacgaccgtaccgttactaacttacgtacgtaaccgacgtaagtacttagggaacgtntaaccgagttaccgaaggtaaaacggngtacgtaagtcggttacttttaggactttacgtacggtacggggaccg

SEQ ID NO: 348127 - DNA, 683 bp, Homo sapiens
  misc_feature: GZ8MTXP02FMCM2.15.86.H09.1.454.CMB.2.raw
  modified_base (282)..(282): a, c, t, g, unknown or other
  misc_feature (282)..(282): n is a, c, g, or t
  modified_base (645)..(645): a, c, t, g, unknown or other
  misc_feature (645)..(645): n is a, c, g, or t
  modified_base (662)..(662): a, c, t, g, unknown or other
  misc_feature (662)..(662): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgccacctaagtagtgagcatcgaacctacaccatacgaatggtatcaacagagaccaacgggaacgtcccccagtaatataatagaaagttaagagtgtangcagaccaacgaccggaacggggacggactacccgagtcgtcttacgagtcggtcctcgtaggttccggtggggtacgaccgtaccgtacctccctaccccaaccctaccctaccctacccctaacccgccgtaacgtccgttacgggaaccgtagttaccggaggtacgttagggtaacgtttacacccgtacgtttaggggagggaaccgagaaccggaccccttaaaggaactaagttacggacgttacgggaaccgtaaaggggtcgggtttgggggacggttccggggaaggaccggaagtaacggcgttacggaccgttacgacggcaacggccgacgccgtccgaccctacgtccnccgttcgccgtaccccncgtaccgtactccgtagcgcg

SEQ ID NO: 348128 - DNA, 604 bp, Homo sapiens
  misc_feature: GZ8MTXP02JZEIB.15.86.H09.1.454.CMB.2.raw
  modified_base (380)..(380): a, c, t, g, unknown or other
  misc_feature (380)..(380): n is a, c, g, or t
tcagtctacgtagccacgaccggtgctcgatttagtgctatagacttgggtttgggggaagaggaagactgacggtcccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcaccccgtgaaaggaagattcacatctcaagagataattacaaaaacgacggtntatttgcaaatgaacagctgaaccgaggacacagccgtctattactgtaccaacagattcggaagtgacatcgacgtaaagaggctaagtgctttgatatctcggggcccgagggaacctagtacggtcggtcgtctcttcaggtccctaccgaccgaaacgggccccaagttcccggtcccttcccccgtcggtccaacccccggtctacccgaaactaccgg

SEQ ID NO: 348129 - DNA, 709 bp, Homo sapiens
  misc_feature: GZ8MTXP02JU7ZT.15.86.H09.1.454.CMB.2.raw
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (274)..(274): a, c, t, g, unknown or other
  misc_feature (274)..(274): n is a, c, g, or t
  modified_base (297)..(297): a, c, t, g, unknown or other
  misc_feature (297)..(297): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgcgtgggagcctcgatcaagctcacctgcacctaagtagtgagcatcgaacctacaccatacgaatggtatacaacagagacgaggactccccagtatataatagaaagtagagtnangnagcacgacggaaggggacggacncccgatcgctcagtcggctccgagttcgtgggctcgaccgctacctcccacctactcctacccaacctccgacgtcgtgggcgtagtgacggcgtagacgtactccgagttgggaggagacgacgccaacacgtattgaagttcggggaaccgtaaaggggttcgggggttcggggttacgggtaccgggggaagggggaaaccggaaccgaacgggtccgttacggaacccggtttaccggtaagggtacccaacccggggtacccccgtaaacggggcccccggttacccccggtccccccgggtttaggtaacccccctttccggtttcccccggttcccccggtttaaccccccctaccccggttacccggttcccggaaccgttttaacccgggacgttacccgggg

SEQ ID NO: 348130 - DNA, 622 bp, Homo sapiens
  misc_feature: GZ8MTXP02J3IPU.15.86.H09.1.454.CMB.2.raw
  modified_base (352)..(352): a, c, t, g, unknown or other
  misc_feature (352)..(352): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (423)..(423): a, c, t, g, unknown or other
  misc_feature (423)..(423): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcacgcccccgtctgcatctgccttgctgggagcctcgatcaagctcacctgccacctaagtagtgagcatcgaacctacaccgatccgaagtggtaactacaacagacgaccgaggaccgtccccagtataataatagaaagttaagagtgactggacacgccacgacggaacggggtacggactccccgatcggtacttcgagttcgggctcagttcgngggtcaggtaccnctacgaccnccancctacgactccatcgnacgtngngcngantcangagagagagcanactattagagtcgaccgtaaggtcggtgggtggttacgggacggggacggaacggtaacgaaccgtcgtaccggtacgttacggtacgaccggaccgaacgaccgttcccggacccggttaccggcctacccggttacccgttcccgtaccccgtaccccgttacccgttcccaccggttaccggtaacgtacccgggg

SEQ ID NO: 348131 - DNA, 675 bp, Homo sapiens
  misc_feature: GZ8MTXP02H38JL.15.86.H09.1.454.CMB.2.raw
  modified_base (316)..(316): a, c, t, g, unknown or other
  misc_feature (316)..(316): n is a, c, g, or t
  modified_base (351)..(351): a, c, t, g, unknown or other
  misc_feature (351)..(351): n is a, c, g, or t
tcagtctacgtagccacgaccggtgctcgatttagtgctatagacttgggtttggggggacttccctggtctccttctacctactgcccttcatttttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacgagggaacgtccccagtatataatagaaagttaagagtgatggcagcaacacgaaggggacggactccccgatcgctcagnggtctccgtagttcgtggggctacgaccgctaccnccaccactccacctaacctcctacgtctgaacgatgaggctagagtactcaagtgggtagagagacgcccaacgacaaagttcgaaagcgggacccgtaaaagggtccggggttttaggggtacgggttacccgggggaacggtaacggggaacccaaaacggggttctacggggtaacccccggtgttaaacggggacctaaaccccggggaccggttaaaccgggccttaccccggggccccccctttagggaccccttaacgtcccgtttaacccgaccccccttaacctccccgttacgtccgttaacgtacggtacccg

SEQ ID NO: 348132 - DNA, 664 bp, Homo sapiens
  misc_feature: GZ8MTXP02F1Y91.15.86.H09.1.454.CMB.2.raw
  modified_base (298)..(298): a, c, t, g, unknown or other
  misc_feature (298)..(298): n is a, c, g, or t
  modified_base (324)..(324): a, c, t, g, unknown or other
  misc_feature (324)..(324): n is a, c, g, or t
  modified_base (364)..(364): a, c, t, g, unknown or other
  misc_feature (364)..(364): n is a, c, g, or t
  modified_base (460)..(460): a, c, t, g, unknown or other
  misc_feature (460)..(460): n is a, c, g, or t
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctcgagggagggctggagtgggttggacgttacaaaagtaaangatggtagaagaaaatagactacggngccgaccgtagaaaggaagattacacctatctacaagaanaataaacttaacgaaaaacgtaggtagttattacgacaaatagaaacagaccgtaagaaccgagaccacacgtccgtactactactacgtaaccanagtacgttacggaacgtgacaagacggtaacggtaaaggcggtatatgttacgtttgatacgtcgtcggggtacccgaggactaacggtgtacgttcgtacgttccgttacgaccgtaccctccgaaccgtaaccgggtccctacgttcccggttcccgttacccccggcgttacccccaccccgtccgtaaccgacgaacccg

SEQ ID NO: 348133 - DNA, 659 bp, Homo sapiens
  misc_feature: GZ8MTXP02GJHS0.15.86.H09.1.454.CMB.2.raw
  modified_base (222)..(222): a, c, t, g, unknown or other
  misc_feature (222)..(222): n is a, c, g, or t
  modified_base (406)..(406): a, c, t, g, unknown or other
  misc_feature (406)..(406): n is a, c, g, or t
  modified_base (651)..(651): a, c, t, g, unknown or other
  misc_feature (651)..(651): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgccacctaagtagtgagcatcgaacctacacatcgaatgtanacaacagacgaccgaggaaccgtaccccagtataataatagaaagttaagagtgatggacagccaacgacggaaggggacggacaccccgagtccgcttcgatggactccggtacgttccggtgggctacgacccaccgttacccaccccaccctacgttaccacccaaccctaccagtccganacggagtgacgtcgtaggattactgaacgtgggtacgacggaagtacgacccaaataactaaagtcgtaaggaccgggaaaccgtaaaggggtcgggggtttgggtaacgggttaccgggggaacggacgggtaaacccgaagtccgtacggtaaccgtaccgtagggccaacggaaccgtacggccgcccggacccctcggtcctaacctccctccgtccccacccgttctaaccgcccggtanacgtacgg

SEQ ID NO: 348134 - DNA, 588 bp, Homo sapiens
  misc_feature: GZ8MTXP02G3PKH.15.86.H09.1.454.CMB.2.raw
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (390)..(390): a, c, t, g, unknown or other
  misc_feature (390)..(390): n is a, c, g, or t
  modified_base (403)..(403): a, c, t, g, unknown or other
  misc_feature (403)..(403): n is a, c, g, or t
  modified_base (411)..(411): a, c, t, g, unknown or other
  misc_feature (411)..(411): n is a, c, g, or t
  modified_base (585)..(585): a, c, t, g, unknown or other
  misc_feature (585)..(585): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgccaccctaagtagtgagcatcgaacctacaccatcgaatggtatcaacagacgaccagggacgtccccagtanaataatgaaagtagngtgactggcagccacgaccgaaggggacggactccccgagtcgctcagtggactcagttcgagggctcggaaccncgtaccnccctaaccatccctaccaaccttccgaagtcctagacgntacgagggtctanaggttacncgagtagacggaagacgacgactaacaatagttagacgtacgacgtaagggtcgggttggtcggtacgggacggaacggaccagcgtacgccgtagtcgacgacgtaccgaggtccgaccgccctcgtacctcttccgtaacccgttcccacccttccacgtacctacggtacncgg

SEQ ID NO: 348135 - DNA, 597 bp, Homo sapiens
  misc_feature: GZ8MTXP02GHXX0.15.86.H09.1.454.CMB.2.raw
  modified_base (443)..(443): a, c, t, g, unknown or other
  misc_feature (443)..(443): n is a, c, g, or t
  modified_base (476)..(476): a, c, t, g, unknown or other
  misc_feature (476)..(476): n is a, c, g, or t
  modified_base (526)..(526): a, c, t, g, unknown or other
  misc_feature (526)..(526): n is a, c, g, or t
  modified_base (572)..(572): a, c, t, g, unknown or other
  misc_feature (572)..(572): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctggggagccttggtaaagcctggggggtcccttagagtctcctgtgtggcctctggattcactttcagtaatggctggatgagttgggtccgccaggctccgagggaaggggctggagtgggttggtacgtttacaaaagtaaaatgagtggtagaagaaaatagactacggtgcgaccgtagaaaggaagtatcgacatctacaagagaataataacaaaaacgtacggtagtattgacaaagtgaacagacctaagaaccgagacacacgccgtatactacntaccacagtagtcggaatgacatcgaagaaggngactatgtacttgatcgtagcgggaccaggactagtggtacgtcgtcctnttcgacgtcctaccgacgacggacctacgtccgtcccttaccccgngtaccccaccgtccacgaacgtccg

SEQ ID NO: 348136 - DNA, 747 bp, Homo sapiens
  misc_feature: GZ8MTXP02FNTRM.15.86.H09.1.454.CMB.2.raw
  modified_base (312)..(312): a, c, t, g, unknown or other
  misc_feature (312)..(312): n is a, c, g, or t
  modified_base (386)..(386): a, c, t, g, unknown or other
  misc_feature (386)..(386): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctgatcaagctcacctgcaccctaagtagtgagcatcgaacctacaccatacgaatggtatacaacagagaccgaggaactccccagtatataatagaaagttaagagtgatggcacgccaacgaacggaaggggacggactccccgancgtctcagtggctcgtagttcgtcggggctcgaccgtctacctaccacctactcctacccaacctcctacgtcngacgtacgtgagtcgtagagtatacgacgttaggacgagagacgtaccaacgaacttaagtacggacgtacggggaaccttaaagggggtaccggggtttgggggtacggtttacccgggggaacgggtaaccggggaaaccgtaacggtaccggtttaacccggtaccccgggttaccggtaacgggttaccccgaaacccgggacccggttaaacggggtccccctttacccccggggtacccccggtttaccggtcccctttaacccgttcccgtttaacccccggtttacccccccttaaccccccgttcccggttaccggtttacccgtaaaccgggtttaccggtaaacccgggg

SEQ ID NO: 348137 - DNA, 645 bp, Homo sapiens
  misc_feature: GZ8MTXP02JD5JP.15.86.H09.1.454.CMB.2.raw
  modified_base (445)..(445): a, c, t, g, unknown or other
  misc_feature (445)..(445): n is a, c, g, or t
tcagtctacgtagccacgaccggtgctcgatttagtgctatagacttgggtttgggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttggtccgcaggctccagggagggctggagtgggttgacgtttcaaaagtaaaatgatggtagagaaaatgactacggtgcacccggtgaaaggtagattcaccatctcaagagataattacaaaaacgcggtagtatttagacaaatcgaaacagtaccctagaaaccggaggaacaccgtagacccgttataatttaccgngtaaccaccgtaagacgtttacggaaagttcgcacttacggaacgtaaaaggcgtaccttaagtcgtattttgaactttgtcgacggggcccctaaggggactaagttcggtctcggtactacgttcaacggtccaccaccgaagggccccctagcccggttaacctcccccgtgaccctacccctccacgaacgacccg

SEQ ID NO: 348138 - DNA, 862 bp, Homo sapiens
  misc_feature: GZ8MTXP02GN7XA.15.86.H09.1.454.CMB.2.raw
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtcgtgggggagccttggtaaagccgtgggggtccctagagtctctgtgtggcctctggattcactttcagtaatggctggatgtaggttcgggtccgccgaggctccgaggggaagggcgtggaggtggggttggtacgttaacgaaaaagtaaatgagtggtagaaagaaaacgtagaacgtacggtacgaccgaaccgtaggaaaggaagtactacaccgtatactacgaaagaagtaaataaacgttaaaacgaaaacgtaggttaagttagttaaccgaaacgaaactaagaaaccaacgtaaccgaaacgggaaacccggtaagaaaccgaacgtaccgtacccgttaacttaaacttactaacgaaaccaaagtagtaaccgttaagggaacgtacggacttaaacggaaccggtaaaagggtaaaaacgggacggtaactttaacgggtttcggtttaactttttaggaaagttaccgggttaccgggggaaaccgggttaaccccggaaaggggtaaccgtaaggttcggggtttaacccggttcgtttccttaccggttacccaaccggttccccctaaaccgggaaacccgggtacccgggtaaccccttaccgggttacccccggttccccgttttaccccccggacgttaaccccccgaccccgtttaccccctaacgggtaacccgtaaccg

SEQ ID NO: 348139 - DNA, 669 bp, Homo sapiens
  misc_feature: GZ8MTXP02HMO6W.15.86.H09.1.454.CMB.2.raw
  modified_base (323)..(323): a, c, t, g, unknown or other
  misc_feature (323)..(323): n is a, c, g, or t
tcagtctacgtagccacgaccggtgctcgatttagtgctatagacttgggtttggggggacttccctggtctccttctacctactgcccttcattttctccacaggtctctttgctctgcctgtgctgactcagcccccgtctgcatctgccttgctgggagcctcgatcaagctcacctgcaccctaagtagtgagcatcgaacctacaccatcgaatggtatcaacagagaccgagggaacgtccccagtatataatagaaagttaagagtgatggcagaccacaccggaaggggacggactccccgatcgctcagtggcncgtttagtcgtggggctgaccgcctacctcacccactcctacccacctcacgtctcgacgatggacgggtctaggaagtactccgtagtggtagggaagagacgaccaaacgtaacaagttggagttcgggaacccgtaaaggggttccggggtttagggggttcggttccggggacgggggaaacgggacccgaaaggtccgtacggtacccggtaccgttacgggcaacggaccccgtaagggtccctccccggtcccccggttcggtaccctccgttcccgtcccggtttcccccggccccttaacccgtccgggtaacctaaccggtcgttaacgccggggg

SEQ ID NO: 348140 - DNA, 825 bp, Homo sapiens
  misc_feature: GZ8MTXP02ICH84.15.86.H09.1.454.CMB.2.raw
  modified_base (514)..(514): a, c, t, g, unknown or other
  misc_feature (514)..(514): n is a, c, g, or t
tcagtctacgtagccacgaccggtgctcgatttagtgctatagacttgggtttggggggacttccctggtctccttctacctactgcccttcatttttctccacaggtctctgtgctctgcctgtgctgactcagcccccgtctgcatctgccttgctgggagcctcgatcaagctcacctgacaccctaagtagtgagcagtaccgaacctacaccatcgaattggtataccaaacgagacgaccgaacgggaaccgtcccccagtaactataaagtagtaaagttaagagtaggatggacacgacccgaaccgaaccggaaacgggggacggtacctaccccgacgttcgcttaccgacgtgggtaccgtccgtaggtttccggcggggtcgtaccggacccgtcctacctcccgacctactcccgtaccaccctacgtacgtctacgacgtagtcgaggtcgtagtcgtaatcgtacgtaggggtacgaagtaacgacggtacccctaaanacgttaaagttcgaacggttacggaaccccggttaaaaggggttcgggggtttgggggttaaccgggttaccggggggacggaaaccgggtaaccggtacgttaccggtaccccgggtaaaccgttaccggggttaggtacccctaaccggggaaaccccgttaaccgggggtccccttttacccccggggacccccgttttcccggggaaccttttacccccgttccccggggttaacccttaacccccccgtttacccggtcccccgtttaacgggtacccgtttaaaacggggttaccctcccggggg

SEQ ID NO: 348141 - DNA, 684 bp, Homo sapiens
  misc_feature: GZ8MTXP02HOFM6.15.86.H09.1.454.CMB.2.raw
  modified_base (633)..(633): a, c, t, g, unknown or other
  misc_feature (633)..(633): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagccccgtctgcatctgccttgctgggagcctcgatcaagctcacctgcaccctaagtagtgagcataccgaacctacaccatcgaatgtatacaacagagacgacggaacgtccccagtataataatagaaagttaagagtagagtggacaacgccaacgaaccggaagggggaaccgggacgtaccccggacgtccgtcttacagtcgggtcctcgtagttcggtgggtctcgtaccgctacctaccacctatcctacctaacctcctagtcgtgacgacgtgacgtactgagtacgtcaacgttggacgggagagacgacctacaactaagttcaggtacggaaccgtaaaggggtcgggtttggggacgggttacggggacggggtacggaacccgagaccggtcggtacccttcggtaacggggcccaaccgtacccggtaaacggtccgtccccggtcccccggttaacggtcccgttaccgtcccgtttcccnccccccggtccttaccccgtccgtaaccgttacggtttacggaacccgggg

SEQ ID NO: 348142 - DNA, 782 bp, Homo sapiens
  misc_feature: GZ8MTXP02IUQBP.15.86.H09.1.454.CMB.2.raw
  modified_base (399)..(399): a, c, t, g, unknown or other
  misc_feature (399)..(399): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgcgtgggagcctcgatcaagctcacctgcaccctaagtagtgagcatacgaacctacaccatacgaatggtatacaacagacgacgaaggaccgtaccccagtatataatagaaagttagagtgatggacagaccacgacggaaggggacggacgtcccgatcgctacgagtcggctcgtagttcgtgggctacgaccgtcctaccgaccacctactcctaccacctcctacgtcgtacgacgngtagacgtctagtagtactacacggtggtaggaggaacgacgaaccaagtaactaaggttacggaacggttaccgggaaacggtttaaacgggggttacgggggtttacgggggttacgggttaccggggggaacgggggtaaacccgggtaaccggtaacgggttacccgtaccgggggttaaccccggttaaccggtttaaccggggacccggtaaccccgggaccccggtaaacggggttcccccgttaacccccgggtaccccccggttacggggttaaccccttaccccgtttcccgggttccccccgttaaccccccgggtccccctttacccgggtaccggttaaccccgtttacgggtaaacccggttcccgggg

SEQ ID NO: 348143 - DNA, 496 bp, Homo sapiens
  misc_feature: GZ8MTXP02GDX5M.15.86.H09.1.454.CMB.2.raw
  modified_base (346)..(346): a, c, t, g, unknown or other
  misc_feature (346)..(346): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
  modified_base (404)..(405): a, c, t, g, unknown or other
  misc_feature (404)..(405): n is a, c, g, or t
  modified_base (410)..(410): a, c, t, g, unknown or other
  misc_feature (410)..(410): n is a, c, g, or t
  modified_base (419)..(419): a, c, t, g, unknown or other
  misc_feature (419)..(419): n is a, c, g, or t
  modified_base (432)..(432): a, c, t, g, unknown or other
  misc_feature (432)..(432): n is a, c, g, or t
  modified_base (454)..(454): a, c, t, g, unknown or other
  misc_feature (454)..(454): n is a, c, g, or t
  modified_base (467)..(467): a, c, t, g, unknown or other
  misc_feature (467)..(467): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctccatcaagctcacctgcaccctagtagtgagcatcgaacctcaccatcgaatggtatcaacagagtaccagggatccccagtatataatgaaagttaagagtgatcgggcagccacaccgaaggggacggatccccgaatcgcgttcatgggactccagtctggggctgacgctacgcacanctcaactccaggtcctgacgatgcggntganactcngtangaggacccnactacagtnnacganaaggcgtgngtggacgagacanctagacgtcagcacgcgaatcncgtccgtacgacnctctaacgccctacncgtcnctacgctcg

SEQ ID NO: 348144 - DNA, 590 bp, Homo sapiens
  misc_feature: GZ8MTXP02I3QDT.15.86.H09.1.454.CMB.2.raw
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacacgaaggggacggatccccgatcgcttcatgggctccgagttcgtggggctgaccgctacctccaccatctaccaacctccagtctgacgatgagtctgagttatctaactggtacggagtacgagcccgaacaacgtaattgaactgggcccaaaggtcgggttacgggtggttaccgggcggaagggacccaaggcctggacccgtactaggtcccaacggcccaaacggcctacggtcccccctagggttcccaccgtttccgcgtttcccccgccccttaccctcggacctttacggagtaccg

SEQ ID NO: 348145 - DNA, 607 bp, Homo sapiens
  misc_feature: GZ8MTXP02H6M9B.15.86.H09.1.454.CMB.2.raw
  modified_base (215)..(215): a, c, t, g, unknown or other
  misc_feature (215)..(215): n is a, c, g, or t
  modified_base (230)..(230): a, c, t, g, unknown or other
  misc_feature (230)..(230): n is a, c, g, or t
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
  modified_base (573)..(573): a, c, t, g, unknown or other
  misc_feature (573)..(573): n is a, c, g, or t
  modified_base (585)..(585): a, c, t, g, unknown or other
  misc_feature (585)..(585): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgcgtgggagcctcgatcaagctcacctgcaccctaagtagtgagcatacgaacctacaccancgaatggtatacaanagagacgaggactaccccagtatataanagaaagtagagagangacagacacgacgaaggggacggcacccgagtcgacttacagtcgggtctccgtaggtacgtcgggctacgacccgtctacctacccacctactccctaccaacctacccgtatccgtagtaacgagtacgagtactagtagtacttcgacgttggaggaccgagtacgaccaaacgtaatacgttagaagttcggaacctaaagggtcgggttgggaggtcgggacggaggacctaagcgttacgcccgtagtacgtacacgaccgtagcccgtccgcccccggtgtacccattccccncgttaccccccnccctacgtacaccgtagacgag

SEQ ID NO: 348146 - DNA, 639 bp, Homo sapiens
  misc_feature: GZ8MTXP02IYAWO.15.86.H09.1.454.CMB.2.raw
  modified_base (389)..(389): a, c, t, g, unknown or other
  misc_feature (389)..(389): n is a, c, g, or t
  modified_base (398)..(398): a, c, t, g, unknown or other
  misc_feature (398)..(398): n is a, c, g, or t
  modified_base (419)..(419): a, c, t, g, unknown or other
  misc_feature (419)..(419): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccaggacgtcccccagtatataatagaaagttaagagtgatggcagcacacgaaggggacggatcccgatcgctcagtaggctccagttctaggggctacgaccgactacctaccaccaacgtcctaccaacctccatccgtagacgatgacgggtntagagtacncgaactgacggaagacgtaanccccaaataacctaaagttagaacttacgggacccttaaaaggggacccggggttttgggggtaacgtttccggggaacgggaacgggtaacccgaaaggcccgttaggaacccgtccgtaaaggtccgaacgaccccgttaaagggcctccggacccccttacggtcctaacctcgtaacgtaccccctaaccgtccgtcaccgttaacgacgtaacgg

SEQ ID NO: 348147 - DNA, 628 bp, Homo sapiens
  misc_feature: GZ8MTXP02FSEJC.15.86.H09.1.454.CMB.2.raw
  modified_base (258)..(258): a, c, t, g, unknown or other
  misc_feature (258)..(258): n is a, c, g, or t
  modified_base (322)..(322): a, c, t, g, unknown or other
  misc_feature (322)..(322): n is a, c, g, or t
  modified_base (383)..(383): a, c, t, g, unknown or other
  misc_feature (383)..(383): n is a, c, g, or t
  modified_base (399)..(399): a, c, t, g, unknown or other
  misc_feature (399)..(399): n is a, c, g, or t
  modified_base (439)..(439): a, c, t, g, unknown or other
  misc_feature (439)..(439): n is a, c, g, or t
  modified_base (498)..(498): a, c, t, g, unknown or other
  misc_feature (498)..(498): n is a, c, g, or t
  modified_base (511)..(511): a, c, t, g, unknown or other
  misc_feature (511)..(511): n is a, c, g, or t
  modified_base (523)..(523): a, c, t, g, unknown or other
  misc_feature (523)..(523): n is a, c, g, or t
  modified_base (528)..(528): a, c, t, g, unknown or other
  misc_feature (528)..(528): n is a, c, g, or t
  modified_base (572)..(572): a, c, t, g, unknown or other
  misc_feature (572)..(572): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtcgtgggggagccttaggtaaagccgtaggggggtcccttagagtctcctgtgtggcctctggattcactttcagtaagtggctggatggagttgggtccncgaggctacgagggaaggggctggaggttggggttacggtaacgtttaacgaaaaagttaaaangtatggtagaaagaaactagactacggtcgacaccgtagaaagagactcacatcacaaganataattaacaaaacgngttataattacgactaagtagaacagacctaaagaaccgngaaacacgtgacccgtattaacgttactacgtaaccaagagtacttagggaatgactanacgaacgtaaagnggtactagtgtntttanagtgtcgcggacaggactagtcgtacgtctctctaccactaccnccgaacgacgtacctcgtcccgtcccttcccgacgaccctccctacgaccgagtcc

SEQ ID NO: 348148 - DNA, 644 bp, Homo sapiens
  misc_feature: GZ8MTXP02I2GWK.15.86.H09.1.454.CMB.2.raw
  modified_base (165)..(165): a, c, t, g, unknown or other
  misc_feature (165)..(165): n is a, c, g, or t
  modified_base (250)..(250): a, c, t, g, unknown or other
  misc_feature (250)..(250): n is a, c, g, or t
  modified_base (311)..(311): a, c, t, g, unknown or other
  misc_feature (311)..(311): n is a, c, g, or t
  modified_base (415)..(415): a, c, t, g, unknown or other
  misc_feature (415)..(415): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
  modified_base (478)..(478): a, c, t, g, unknown or other
  misc_feature (478)..(478): n is a, c, g, or t
tcagtctacgtagccacgaccggtgctcgatttagtgctatagacttgggtttgggggaagaggaagactgacggtccccccaggagttcgggctgagctgggtttccttgctgctatcttaaaaggtgtccagtgtgaagtgcaggtggtggagtctggggganccttggtaaagcctggggggtcccttagagtctcctgtgtggcctctggattcactttcagtaatggctggatgagttgggtccnccaggctccgaggggaagggctggagtggggttgacgtttcaaaagtaaaatgaactggtnagaaaatgactacggtgcaaccgtgaaaggagattcaccatctcaaagacgataattacaaaaaacgcggtatattgacaaaatgaactagccctagaaaccgngaacacagccgtntaattacngtaccacagacttcggaagttgacagtacgacggtaaaaggngtactagtcgtacgttttagattacgtccgtacggggaccctagggaactaagttcggtaccgtcgtcttacgttacgaccggtccctaccgaaccgtacgggtaccctacgtaccgttcccgttacccccgtacggcccctacccgtaccctaccgaaacgtccg

SEQ ID NO: 348149 - DNA, 955 bp, Homo sapiens
  misc_feature: GZ8MTXP02GWQLU.15.86.H09.1.454.CMB.2.raw
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtcgtgggggagccttggtaaagccgtggggggtcccttagagtctcctgtgtggcctcgtggattcactttcagtaatggctgatgagttgggtccgctaggctccgaggggaaggggctgggaggttggggttaggtacgtttaacaaaaagtaaaatgaagtggtagaagaaaatagaacgtacggtagaccaacccggtaaggaaaacggaaagtactttaccgaacctaactactacgaaaaggtaagtaaacttaaaacgttaacgtaaaaaaacggtaccggggttaagtttaacttttaaccggaaacctaaaaagttaccggaaaaactaaccggtaacccgttaaacggaaaacccgggaaacggggaaaccgttaaacccgaaaccggttacccccgttaacgtttaaacctttaaaccgttaaaccgggaaaccccctaacgttaaagtaacggtttaaacggggtaaaccgttgaaaccaaaccggttaaccgggtaaaaccgggtaaaaaggggcggtaaacctttaacgttaggttaccgttttttaggaaaccttttaaacgggttcccggtaaaccggggggaaccccttaaagggggacccgttaaaggttaccggggttcccggtttaacgttccctttaaacttaccggaaaccgttcccccgtaaacccgacccggaaaacccgggggtccccctaacggtttcccccggggtccccttcccccccggtacggtaccccctaaacccccgtcccctaaaccggttaaccggaaacccg

SEQ ID NO: 348150 - DNA, 583 bp, Homo sapiens
  misc_feature: GZ8MTXP02J1CA0.15.86.H09.1.454.CMB.2.raw
  modified_base (228)..(228): a, c, t, g, unknown or other
  misc_feature (228)..(228): n is a, c, g, or t
  modified_base (254)..(254): a, c, t, g, unknown or other
  misc_feature (254)..(254): n is a, c, g, or t
  modified_base (268)..(268): a, c, t, g, unknown or other
  misc_feature (268)..(268): n is a, c, g, or t
  modified_base (335)..(335): a, c, t, g, unknown or other
  misc_feature (335)..(335): n is a, c, g, or t
  modified_base (386)..(386): a, c, t, g, unknown or other
  misc_feature (386)..(386): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (400)..(400): a, c, t, g, unknown or other
  misc_feature (400)..(400): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacngagaccaggaagtcccccagtactanaatgtaaagtaagntgatggcagccacgaccgaaggggtacggactccccgatccgcttacagtggactccgagtttccgnggggtctcgacgtcctacgtcccaccgatcaccacctcgtgtctgacgagngngctgntactcgntgtgagagacgacacacgtagtagtagtacgacgaacggtacggtggtcggtcgggacggacggacgacgacgtcgtaccgtacgtacgtacgacgaccgaccgccgtccgtcccgtaccgtaccgtaccgtccgttcccgttaccccgtacccgtacccgtaccgtaccgtaccgtacgtcg

SEQ ID NO: 348151 - DNA, 549 bp, Homo sapiens
  misc_feature: GZ8MTXP01CZ5AT.4.19.B08.1.454.CMB.2.raw
  modified_base (278)..(278): a, c, t, g, unknown or other
  misc_feature (278)..(278): n is a, c, g, or t
  modified_base (401)..(401): a, c, t, g, unknown or other
  misc_feature (401)..(401): n is a, c, g, or t
  modified_base (487)..(487): a, c, t, g, unknown or other
  misc_feature (487)..(487): n is a, c, g, or t
  modified_base (496)..(496): a, c, t, g, unknown or other
  misc_feature (496)..(496): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggaggcgtggtccagcctgggaggtccctgagactctcctgtatagcctctggattcaccttcggcagttangctatgcacgtgggtccgccaggcctccgaggcgtaagggggttggaggtggggtggcagcaatatcatatgatggaatgaataaaatattaacatagagttcgagaagggtcattcacatcncagagacaatcgacaaagacacactgtatctaggaaatgaccagcctgagaggtgacgacgtacggggttaatttagttacgtggngtaccgggngggttaagttggaggtcttacgaagttcggtaggacttaacgaacgtttaagg

SEQ ID NO: 348152 - DNA, 606 bp, Homo sapiens
  misc_feature: GZ8MTXP01DFAKJ.4.19.B08.1.454.CMB.2.raw
  modified_base (254)..(254): a, c, t, g, unknown or other
  misc_feature (254)..(254): n is a, c, g, or t
  modified_base (277)..(277): a, c, t, g, unknown or other
  misc_feature (277)..(277): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggagcgtggtccagcctgggagtccctgagactctcctgtatagcctntggattcaccttcggctagttangctatgcacgtcgggtcccgcgaggcctccgaggacggtaagggggttggaggtggggtgcagactaatatactatatagagtaggaagtagtaataaaaattaattaataataagtagtacgtaggtaagggtacgtactactactactactacagaagaacaactacgaacaaacgaaacaacactagtagtacgtaagtaaagtacgaacgacgacgtagaagaggtagacgacgtacggttaagtttaagttagttagttggtcggacgggagttaggacggtaacgtacgtaacgtacggtaggttacgtaacgttaacgtaag

SEQ ID NO: 348153 - DNA, 628 bp, Homo sapiens
  misc_feature: GZ8MTXP01CZIZ8.4.19.B08.1.454.CMB.2.raw
  modified_base (254)..(254): a, c, t, g, unknown or other
  misc_feature (254)..(254): n is a, c, g, or t
  modified_base (277)..(277): a, c, t, g, unknown or other
  misc_feature (277)..(277): n is a, c, g, or t
  modified_base (295)..(295): a, c, t, g, unknown or other
  misc_feature (295)..(295): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggagcgtggtccagccgtgggagtccctgagactctctgtatagcctntggattcaccttcggctagttangctatgcacgtgggtccncaggctccgaggcgaagggggttgagtgggngcagcaatntcatatgagtaggaagtagaactaaaaaattattaacataaggaggttacccgtagggaaacggggttcaatttcaacctactctaccgaagtaacgaacaaacgtacggaacaaaacgaaaccaactaacttaggttaactacgtaggaaaatcgaaccagtccgtaggaacggtaggtacgaacggtaaccgttgggggtttaattttacgttagttggttacggacggtggggttaagttggacgggtaactacggtaagttacgggtaggaacttaacgaagttttaag

SEQ ID NO: 348154 - DNA, 572 bp, Homo sapiens
  misc_feature: GZ8MTXP01C57K9.4.19.B08.1.454.CMB.2.raw
  modified_base (254)..(254): a, c, t, g, unknown or other
  misc_feature (254)..(254): n is a, c, g, or t
  modified_base (277)..(277): a, c, t, g, unknown or other
  misc_feature (277)..(277): n is a, c, g, or t
  modified_base (298)..(298): a, c, t, g, unknown or other
  misc_feature (298)..(298): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (489)..(489): a, c, t, g, unknown or other
  misc_feature (489)..(489): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggaggcgtggtccagcctgggagtccctgagactctctgtatagcctntggattcaccttcggctagttangctatgctacgtcgggtcccncaggcctccgaggcgaagggggttggaggtggggtggcaagcaaattatcatagtgataggaagtgaataaaaatattaacatagagtcgtagagggtcattcagcatcncaganacaatcgacaagacacactaggtatcgtaaggaatcgaccagctagaggtaggtagacgtaacgtaacggggtttnttaagttacgttggtaggccgggttaggggttacgttagggaacgggtctcgtaaggtcggttaggtaacttaacgttaaacg

SEQ ID NO: 348155 - DNA, 579 bp, Homo sapiens
  misc_feature: GZ8MTXP01AH8D4.4.19.B08.1.454.CMB.2.raw
  modified_base (254)..(254): a, c, t, g, unknown or other
  misc_feature (254)..(254): n is a, c, g, or t
  modified_base (276)..(276): a, c, t, g, unknown or other
  misc_feature (276)..(276): n is a, c, g, or t
  modified_base (294)..(294): a, c, t, g, unknown or other
  misc_feature (294)..(294): n is a, c, g, or t
  modified_base (332)..(332): a, c, t, g, unknown or other
  misc_feature (332)..(332): n is a, c, g, or t
  modified_base (455)..(455): a, c, t, g, unknown or other
  misc_feature (455)..(455): n is a, c, g, or t
  modified_base (471)..(471): a, c, t, g, unknown or other
  misc_feature (471)..(471): n is a, c, g, or t
  modified_base (491)..(491): a, c, t, g, unknown or other
  misc_feature (491)..(491): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggagcgtggtccagcctgggagtccctgagactctcctgtatagcctntggattcaccttcggcagttangctatgcacgtgggtccncaggctccgaggcaagggggtgagtgggtgcagcaatncatatgataggaagtgaattaaaaactattaacataggagtccgtaggaagggtcattcacatctacagagacaatcgacaaagaaacacgtaactgtaactacgtaagggaaatacgaaccngacctggaagagggtnaacggtacgtacggggtttntttaacgttccgtaggttcggccgggtacgggagttacggacgggtctacgtaagttcgggtaggacttaaccgttaacgtttaaggg

SEQ ID NO: 348156 - DNA, 507 bp, Homo sapiens
  misc_feature: GZ8MTXP01C3EHW.4.19.B08.1.454.CMB.2.raw
  modified_base (275)..(275): a, c, t, g, unknown or other
  misc_feature (275)..(275): n is a, c, g, or t
  modified_base (362)..(362): a, c, t, g, unknown or other
  misc_feature (362)..(362): n is a, c, g, or t
  modified_base (445)..(445): a, c, t, g, unknown or other
  misc_feature (445)..(445): n is a, c, g, or t
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
  modified_base (458)..(458): a, c, t, g, unknown or other
  misc_feature (458)..(458): n is a, c, g, or t
  modified_base (465)..(465): a, c, t, g, unknown or other
  misc_feature (465)..(465): n is a, c, g, or t
  modified_base (487)..(487): a, c, t, g, unknown or other
  misc_feature (487)..(487): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggagcgtggtccagccgtgggagtccctgagactctctgtatgcctctggattcaccttcggcagttangctatgcacgtcgggtccgcaggcctccgaggcgaagggggttgagtggggtgcagcaatatcatatgatggaatgaataaaaactntaacatagagtcgtgaggtcattcacatctccagacgacaatcgacaaagaacacactgtatcaggaaatcgacagcctgagngtnacgnagggtnttattcngttgcgcgggattgaggctacngtcgtggataacgaattaag

SEQ ID NO: 348157 - DNA, 559 bp, Homo sapiens
  misc_feature: GZ8MTXP01CA15W.4.19.B08.1.454.CMB.2.raw
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
  modified_base (296)..(296): a, c, t, g, unknown or other
  misc_feature (296)..(296): n is a, c, g, or t
  modified_base (341)..(341): a, c, t, g, unknown or other
  misc_feature (341)..(341): n is a, c, g, or t
  modified_base (407)..(407): a, c, t, g, unknown or other
  misc_feature (407)..(407): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggaggcgtggtccagcctgggagtccctgagactctcctgtatagcctntggattcaccttcggcagttangctatgcacgtgggtcccnccaggcctccgaggcgaagggggttggagtggggtggcagcaatntcatatgatggaagtgaataaaatattaacataggagtccgtggaagggtcattcacatctcaganacaatcgacaagacacactgtatctaggaaactcgaccagccctaggagagggtgacgtacgtacggggttgtttaattacgtggttgcgggacgggttagttcggacgggtctacgtaagtccggtagggacttaaccgaaacgtttaagg

SEQ ID NO: 348158 - DNA, 683 bp, Homo sapiens
  misc_feature: GZ8MTXP01CA3SX.4.19.B08.1.454.CMB.2.raw
  modified_base (252)..(252): a, c, t, g, unknown or other
  misc_feature (252)..(252): n is a, c, g, or t
  modified_base (276)..(276): a, c, t, g, unknown or other
  misc_feature (276)..(276): n is a, c, g, or t
  modified_base (298)..(298): a, c, t, g, unknown or other
  misc_feature (298)..(298): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttggctgagctgggtcttcctcgttgttcttttaagaggtgtccagtgtcaggtgaaattggtggactcgtgggggagcgtggtccagccgtgggagtccctgagctctctgtatcgcctntggtattcaccgttggctagttangctagtcgcacgtcgggtcccncgaggcctaccgaggcggtaagggggttggaggtgggggtgacgaaggactaaatcgtactaatagtagaaggtagggaaagttagtaaattaaaaaaattattaacagttaagggtaacgggttaccggtaagggtaacggggtctaaactttccgaaacctacttaccaccgaagtaacgaactaaacgcgaacaaacgaaacactaacgttagtaacgtaacgtaaagggtaaaactccggaaccgaaacggtccgtaagggaaccggtaaggtccgaaacgtaccggttagggttaagttttaacttacggttggttgggaccggtagggttagttacgggagtcctacgtaagtcggagttaactaacgttaaagttttg

SEQ ID NO: 348159 - DNA, 557 bp, Homo sapiens
  misc_feature: GZ8MTXP01BW2ZL.4.19.B08.1.454.CMB.2.raw
  modified_base (252)..(252): a, c, t, g, unknown or other
  misc_feature (252)..(252): n is a, c, g, or t
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
  modified_base (348)..(348): a, c, t, g, unknown or other
  misc_feature (348)..(348): n is a, c, g, or t
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
  modified_base (400)..(400): a, c, t, g, unknown or other
  misc_feature (400)..(400): n is a, c, g, or t
  modified_base (493)..(493): a, c, t, g, unknown or other
  misc_feature (493)..(493): n is a, c, g, or t
  modified_base (501)..(501): a, c, t, g, unknown or other
  misc_feature (501)..(501): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggagcgtggtccagcctgggagtcctgagactctctgtatagcctntggatcaccttcggctagttangctatgcacgtgggtcccncaggctccgaggcgaagggggttggagtgggtgcagcaatncatntgatggaatnataaaatataanatagagtcgnggaagggtctatcactatcncagagacaancgacaagaacacactagtatcgtaaggtaaactcggaccagccgtaggaaggtacggtagacggtacgtacggggttaatttaattacgtggngtaccggngggttagttgggacgcttacgaacgttggtacggttataaccgttaaacgtttggg

SEQ ID NO: 348160 - DNA, 569 bp, Homo sapiens
  misc_feature: GZ8MTXP01BYPPH.4.19.B08.1.454.CMB.2.raw
  modified_base (253)..(253): a, c, t, g, unknown or other
  misc_feature (253)..(253): n is a, c, g, or t
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
  modified_base (367)..(367): a, c, t, g, unknown or other
  misc_feature (367)..(367): n is a, c, g, or t
  modified_base (390)..(390): a, c, t, g, unknown or other
  misc_feature (390)..(390): n is a, c, g, or t
  modified_base (482)..(482): a, c, t, g, unknown or other
  misc_feature (482)..(482): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggagcgtggtccagccgtgggagtcctgagactctctgtatagcctntggattcaccttggcagttangctatgcacgtgggtcccncaggcctccgaggcgtaagggggttgagtgggngcagcaatncatatgatggaatnaataaaatntaacatagngtccgtagagggtcatcacatcncagagaacatcgacaaagaacaacgtactagtatacgtaaggaaactcgaaccagccgtaagacggaggtcgaaaccgtcggtaacgggttnttttaacgttacgtggttcgccggggtaggaagttacggacgggtctacgtaagttcggtaggttaacttaaccgttaagtttaagg

SEQ ID NO: 348161 - DNA, 548 bp, Homo sapiens
  misc_feature: GZ8MTXP01B3USE.4.19.B08.1.454.CMB.2.raw
  modified_base (169)..(169): a, c, t, g, unknown or other
  misc_feature (169)..(169): n is a, c, g, or t
  modified_base (254)..(254): a, c, t, g, unknown or other
  misc_feature (254)..(254): n is a, c, g, or t
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
  modified_base (365)..(365): a, c, t, g, unknown or other
  misc_feature (365)..(365): n is a, c, g, or t
  modified_base (398)..(398): a, c, t, g, unknown or other
  misc_feature (398)..(398): n is a, c, g, or t
  modified_base (520)..(520): a, c, t, g, unknown or other
  misc_feature (520)..(520): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagnggtgtccagtgtcaggtgaaattggtggactcgtgggggagcgtggtccagcctgggagtccctgagactctcctgtatagcctntggacttcaccttcggctagttangctatgctacgtcgggtccncaggcctccgaggcgtaagggggttgagtgggtgcagcaatntcatngatggaagtnaattaaaatnttaacatagagtcgtagaagggtcatcacatcncagagacaatcgacaagacacactacgtagtctaggaaatcgaacctagccgtggaggtaggtacgacgtacgtacggggttaatttacgttacgtggttggcggcgggattggacggctangtcggtagttactaacgttaacgttaag

SEQ ID NO: 348162 - DNA, 676 bp, Homo sapiens
  misc_feature: GZ8MTXP01BJL1E.4.19.B08.1.454.CMB.2.raw
  modified_base (168)..(168): a, c, t, g, unknown or other
  misc_feature (168)..(168): n is a, c, g, or t
  modified_base (282)..(282): a, c, t, g, unknown or other
  misc_feature (282)..(282): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttggctgagctgggtcttcctcgttgttcttttaagnggtgtccagtgtcaggtgaaattggtggactcgtgggggagcgtggtccagccgtgggacgtccctgagactctcctgtatacgcctctggtacttcaccgttcggctagttangctatcgctacggtcgggtcccgcaggcctccgaggcgtaagggggttgaggtggggtgcagacaatatcaatagtgacgtagggaaagtagaaattaaaaacgttattaacgaagttaagggaacggttccggtaagggtaaacggggtctaattaccaacctattccacgaagaagaaaccctaaagtccgaacaaaacgaactaaccgtacgttaggttaactacggtaaggaaacttccgaaacccgaggtccctagggaaaggtggtacggtaaacccggtaacggttaggggttttcgttttaaacgttcggtagggttcggaccgggtagggttagttcgggaggttcctagtaacgttgggaacgttattaacgttaagtttaagg

SEQ ID NO: 348163 - DNA, 688 bp, Homo sapiens
  misc_feature: GZ8MTXP01ATDYL.4.19.B08.1.454.CMB.2.raw
  modified_base (256)..(256): a, c, t, g, unknown or other
  misc_feature (256)..(256): n is a, c, g, or t
  modified_base (280)..(280): a, c, t, g, unknown or other
  misc_feature (280)..(280): n is a, c, g, or t
  modified_base (349)..(349): a, c, t, g, unknown or other
  misc_feature (349)..(349): n is a, c, g, or t
  modified_base (368)..(368): a, c, t, g, unknown or other
  misc_feature (368)..(368): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggagcgtggtccagccgtgggagtccctgacgactctcctgtatagcctntggacttcaccttcggctagttangctatcgctacgtcgggtccgccgaggcctccgaggcgtaagggggttggagtggggtgcagacaagtnacatagtgataggaagtanaattaaaaattattaacgagtagacggtccggtaggtaacggggtctacttccaactacttaccgtaccgaagtacgaaaccaacgtcggaaccaaaagaaacccaactacgttaggtactaccggtaagggtaaactcggaaacccgagttacccgtagggaaaccggtagggtaacggtaaacggtaacccggttaagggggtttaattttaaacgttacgggtaccggtttggggaaccgggtacggggttaagttgggaaccggttctccgtaagtttaccgggacggttaatttaacccgttaacgttttaaggg

SEQ ID NO: 348164 - DNA, 578 bp, Homo sapiens
  misc_feature: GZ8MTXP01EGF4C.4.19.B08.1.454.CMB.2.raw
  modified_base (195)..(195): a, c, t, g, unknown or other
  misc_feature (195)..(195): n is a, c, g, or t
  modified_base (282)..(282): a, c, t, g, unknown or other
  misc_feature (282)..(282): n is a, c, g, or t
  modified_base (303)..(303): a, c, t, g, unknown or other
  misc_feature (303)..(303): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (361)..(361): a, c, t, g, unknown or other
  misc_feature (361)..(361): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
  modified_base (457)..(457): a, c, t, g, unknown or other
  misc_feature (457)..(457): n is a, c, g, or t
  modified_base (462)..(462): a, c, t, g, unknown or other
  misc_feature (462)..(462): n is a, c, g, or t
  modified_base (475)..(475): a, c, t, g, unknown or other
  misc_feature (475)..(475): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggnggactcgtggggggaggcgtggtccagcctgggacgtccctgagtactctctagtatagcctctggtattcgaccttcggcagttangctatcgctacgtgggtcccncaggctccgaggcgtaagggggtggagtgggtgcagcaattncatntgataggaagtnaataaaactataacgatagacgtcgtagacgggtctatcactntcncgaagaacanactnaacgaaanacctanacgtatacgtaagacgtaaacncgacncgcgtaggaaggngtacgacgtacggttagggttaattaacgttcggtggttacggacgggtagggttaacttggacggtcagtaacgtacggagttaacttaacgttaagttaag

SEQ ID NO: 348165 - DNA, 675 bp, Homo sapiens
  misc_feature: GZ8MTXP01AXN9F.4.19.B08.1.454.CMB.2.raw
  modified_base (170)..(170): a, c, t, g, unknown or other
  misc_feature (170)..(170): n is a, c, g, or t
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
  modified_base (332)..(332): a, c, t, g, unknown or other
  misc_feature (332)..(332): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagttggctgagctgggtcttcctcgttgttctttaagaggtntccagtgtcaggtgaaattggtggactcgtggggggagcgtggtccagccgtgggagtccctgagactctcctgtatgcctcngattcacttgnagttngctangcacgtcgggccncaggcctcgaggcgtaagggggtggaggtgggtgcagactaaatntcataatgaatagggaaatagtaaattaaaaaattattaacgtagtaacgggtacgttaccgggtaggtaaacgggggtctaactttaccaacctacgtccttaccgaagaacgaactaacgtccgaaacaaacggaacaactaacgttagtaaagttacgtaaacgggtaaaactcgggaaacccaaggtccgttaaggaaagggtacgggtaaggtaaaccccggtaagggttacgggtttaacgttttaacgttaccggtggttacgggaccgggtacgggttaagttagggacggtctacggtaatacgggttagttaaactaaccgttaagtttaagg

SEQ ID NO: 348166 - DNA, 494 bp, Homo sapiens
  misc_feature: GZ8MTXP02I2IX3.4.19.B08.1.454.CMB.2.raw
  modified_base (293)..(293): a, c, t, g, unknown or other
  misc_feature (293)..(293): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
  modified_base (384)..(384): a, c, t, g, unknown or other
  misc_feature (384)..(384): n is a, c, g, or t
  modified_base (450)..(450): a, c, t, g, unknown or other
  misc_feature (450)..(450): n is a, c, g, or t
  modified_base (477)..(477): a, c, t, g, unknown or other
  misc_feature (477)..(477): n is a, c, g, or t
  modified_base (482)..(482): a, c, t, g, unknown or other
  misc_feature (482)..(482): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggggagcgtggtccagcctgggaggtccctgagactctcctgtatagcctctggattcaccttcggcagttatgctatgcactgggtccnccaggctccaggcaaggggtgagtgggtgcagcaatatcatatgatggaatgataaatnttanatagagtcgngaaggtcattcaccatcncagagacatcgacaaagaacacaactgtaatctagaaatgaccagcctgagagtgacgacagggtntttatactgtagcgcggatagaggctnatcgngactacaattag

SEQ ID NO: 348167 - DNA, 502 bp, Homo sapiens
  misc_feature: GZ8MTXP02FS62W.4.19.B08.1.454.CMB.2.raw
  modified_base (329)..(329): a, c, t, g, unknown or other
  misc_feature (329)..(329): n is a, c, g, or t
  modified_base (457)..(457): a, c, t, g, unknown or other
  misc_feature (457)..(457): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggagcgtggtccagcctgggaggtccctgagactctcctgtatagcctctggattcaccttggcagttatgctatgcactgggtccgcaggctcaggcaaggggttgagtgggtgcagcaatntcatatgatggaagtgaataaatattacatagagtccgtgaagggtcattcaccatctccagagacaatcgacaagaacacactgtaatctaggaaatgaaccagcctgagaggtgacgacgacggtntttatactgtgcgcggatgaggctacgatcgtggatacgacttag

SEQ ID NO: 348168 - DNA, 563 bp, Homo sapiens
  misc_feature: GZ8MTXP02JYO6G.4.19.B08.1.454.CMB.2.raw
  modified_base (298)..(298): a, c, t, g, unknown or other
  misc_feature (298)..(298): n is a, c, g, or t
  modified_base (349)..(349): a, c, t, g, unknown or other
  misc_feature (349)..(349): n is a, c, g, or t
  modified_base (367)..(367): a, c, t, g, unknown or other
  misc_feature (367)..(367): n is a, c, g, or t
  modified_base (390)..(390): a, c, t, g, unknown or other
  misc_feature (390)..(390): n is a, c, g, or t
  modified_base (400)..(400): a, c, t, g, unknown or other
  misc_feature (400)..(400): n is a, c, g, or t
  modified_base (479)..(479): a, c, t, g, unknown or other
  misc_feature (479)..(479): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggaggcgtggtccagcctggggaggtccctgagactctcctgtatagcctctggattcaccttcggcagttatgctatgcacgtggggtccnccaggcctccagggcgaaggggttggaggtggggtggcagcaatatcatangatggaagtgaataaatnttacatagacgtcgagaagggtnattcacatcncagagacaatcgacaagacacactgtatcgtaggaaatgaaccagccgtagaggacggtagacgacgtaacgggggttntttaagtacgtggtcggcggtacgggggaattagggacggtcctacgaacgttcgggtaaggaacttaaccgtaacgtttaagg

SEQ ID NO: 348169 - DNA, 517 bp, Homo sapiens
  misc_feature: GZ8MTXP02GVIPE.4.19.B08.1.454.CMB.2.raw
  modified_base (295)..(295): a, c, t, g, unknown or other
  misc_feature (295)..(295): n is a, c, g, or t
  modified_base (340)..(340): a, c, t, g, unknown or other
  misc_feature (340)..(340): n is a, c, g, or t
  modified_base (389)..(389): a, c, t, g, unknown or other
  misc_feature (389)..(389): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggaggcgtggtccagcctgggaggtccctgagactctcctgtatagcctctggattcaccttcggcagttatgctatgcactgggtccnccaggctccgaggcaaggggttgagtgggtgcagcaatatcatangatggaatgataaatattacatagagtccgtgaagggtcattcacatcncagagacaatcgacaagaacacactgtaatctaggaaatgaccagcctagagaggtgacgacgtacgggttatttatactggtggcggtcgggaataggaggctcaagtcgaggaactacaacgttag

SEQ ID NO: 348170 - DNA, 599 bp, Homo sapiens
  misc_feature: GZ8MTXP02IKA7J.4.19.B08.1.454.CMB.2.raw
  modified_base (297)..(297): a, c, t, g, unknown or other
  misc_feature (297)..(297): n is a, c, g, or t
  modified_base (331)..(331): a, c, t, g, unknown or other
  misc_feature (331)..(331): n is a, c, g, or t
  modified_base (342)..(342): a, c, t, g, unknown or other
  misc_feature (342)..(342): n is a, c, g, or t
  modified_base (478)..(478): a, c, t, g, unknown or other
  misc_feature (478)..(478): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggaggcgtggtccagcctgggaggtccctgagactctcctgtatagcctctggattcaccttcggcagttatgctatgcacgtgggtcccnccgaggctccgaggcgaaggggttggagtggggngcagacaatancaatgtgagtggaagtagaattaaattattacagtagacgtaccgtaggagggtctattcacattcaccagaagaactaactacgacaaaagaacctactacgtagttaactacgttaagggaaaatcggaaaccncgaccgttaggacgtaggtacgaacgtacgtacggggtttatttaacgtacgtgggttacggacggtacggggaattaggacggtcctacgattcgggagtaacttaaccgaacgtttagg

SEQ ID NO: 348171 - DNA, 522 bp, Homo sapiens
  misc_feature: GZ8MTXP02J1EUW.4.19.B08.1.454.CMB.2.raw
  modified_base (296)..(296): a, c, t, g, unknown or other
  misc_feature (296)..(296): n is a, c, g, or t
  modified_base (352)..(352): a, c, t, g, unknown or other
  misc_feature (352)..(352): n is a, c, g, or t
  modified_base (469)..(469): a, c, t, g, unknown or other
  misc_feature (469)..(469): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggaggcgtggtccagcctgggaggtccctgagactctcctgtatagcctctggattcaccttcggcagttatgctatgcacgtgggtccncaggctccgaggcaaggggttgaggtggggtgcagcaatatcatatgatggaagtnataaatatacatagagtcgtagaagggtcatcaccatctacagagacaaatcgacaaagaaccacactgtatcgtaggaaatgaaccagcctagagaggtgaacgacgacggggttntttatactggtgcggcgggatagacggctacgagtcgtaggataacgaattag

SEQ ID NO: 348172 - DNA, 573 bp, Homo sapiens
  misc_feature: GZ8MTXP02HNO3F.4.19.B08.1.454.CMB.2.raw
  modified_base (296)..(296): a, c, t, g, unknown or other
  misc_feature (296)..(296): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggagcgtggtccagcctgggagtccctgagactctcctgtatagcctctggattcaccttcggcagttatgctatgctacgtcgggtccnccaggcctccgagggcgaaagggggttgaggtggggtgcagcaaagtatcatatgataggaatgaataaaatattacaagtagagtccgtaggaagggtctattcaccatctacagagacaatcgacaaagaacacactagtatcgtaggaaatgaaccagtacccgtagaaggtaggtacgaaccggacgtaacgggggttactttaagttactggttcggacgtcggggtaactaggaacggtctacgagtcgtaggactaccgtaaaactttgg

SEQ ID NO: 348173 - DNA, 532 bp, Homo sapiens
  misc_feature: GZ8MTXP02G6LX1.4.19.B08.1.454.CMB.2.raw
  modified_base (294)..(294): a, c, t, g, unknown or other
  misc_feature (294)..(294): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (386)..(386): a, c, t, g, unknown or other
  misc_feature (386)..(386): n is a, c, g, or t
  modified_base (399)..(399): a, c, t, g, unknown or other
  misc_feature (399)..(399): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggagcgtggtccagcctgggaggtccctgagactctcctgtatagcctctggattcaccttcggcagttatgctatgcactgggtccncaggctccaggcaaggggtgagtgggtggcagcaatancatangatggaatgaataaatatacatagagtccgtgaagggtcattcacatcncagagacatcganaagacacactgtatcgtagaaatcggaaccagcctaggagaggtgaacgacgacgggttattagttacgcgttggacggtacgggatacggaggtcctagagttacggtaggtaaactacgtaacgtttaagg

SEQ ID NO: 348174 - DNA, 578 bp, Homo sapiens
  misc_feature: GZ8MTXP02F9BVH.4.19.B08.1.454.CMB.2.raw
  modified_base (277)..(277): a, c, t, g, unknown or other
  misc_feature (277)..(277): n is a, c, g, or t
  modified_base (344)..(344): a, c, t, g, unknown or other
  misc_feature (344)..(344): n is a, c, g, or t
  modified_base (411)..(411): a, c, t, g, unknown or other
  misc_feature (411)..(411): n is a, c, g, or t
tcagagcactgtagcacgaccggtgctcgatttagtgagtcagtaagggtgggagaggagcccagcactggaagtcgccggtgtttccattcggtgatcagcactgaacacagaggactcaccatggagtttgggctgagcgtggtcttcctcgttgttcttttaagaggtgtccagtgtcaggtgaaattggtggactcgtgggggaggcgtggtccagcctgggaggtccctgagactctcctgtatagcctctggattcaccttcggcagttangctatgcactgggtccgccaggcctccaggcaagggggttggagtggggtggcagcaaatatcatangatggaatgataaatattcagtagagtccgtgaagggtcgattcacatctacagagacaatccgaanaaagacactactgtatcgtaagaaatcgaaccagccgtaggaaggtaggtaggaccggtaacgtacggggtttagtttaacgtttacgtcgggtacggacggggtacggggtaacgtaggacggtcgtacgtaacgttccgggtaggtaactaaccgtaagtttacg

SEQ ID NO: 348175 - DNA, 622 bp, Homo sapiens
  misc_feature: GZ8MTXP02HLWCB.4.19.B08.1.454.CMB.2.raw
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggaggcgtggtccagccgtgggaggtccctgagactctcctgtatagcctctggattcatcttcggctagttatgctatgcacgtcggggtcccgccgaggcctccgaggcggtaagggggttggaggtggggtggacaggacaaatatcaatagtgatagggaagttagaaattaaaactattaaacaagtaaggtacgttaccggtagggaaacggggttctaacttccaaccctatacctaccgaagaacgaacaatccgaacaaacgaacaacacttagtaatacgtaggaaatacgaccagacctaggaggaggtacgacgaacgttacggggttatttaacgttacgtggtacggcggtacgggtaagtaggaacggtctacgtagtacggtacggtaactaacgtaacg

SEQ ID NO: 348176 - DNA, 534 bp, Homo sapiens
  misc_feature: GZ8MTXP02FR18D.4.19.B08.1.454.CMB.2.raw
  modified_base (169)..(169): a, c, t, g, unknown or other
  misc_feature (169)..(169): n is a, c, g, or t
  modified_base (276)..(276): a, c, t, g, unknown or other
  misc_feature (276)..(276): n is a, c, g, or t
  modified_base (295)..(295): a, c, t, g, unknown or other
  misc_feature (295)..(295): n is a, c, g, or t
  modified_base (335)..(335): a, c, t, g, unknown or other
  misc_feature (335)..(335): n is a, c, g, or t
  modified_base (339)..(339): a, c, t, g, unknown or other
  misc_feature (339)..(339): n is a, c, g, or t
  modified_base (356)..(356): a, c, t, g, unknown or other
  misc_feature (356)..(356): n is a, c, g, or t
  modified_base (468)..(468): a, c, t, g, unknown or other
  misc_feature (468)..(468): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagnggtgtccagtgtcaggtgaaattggtggactcgtgggggagcgtggtccagcctgggagtccctgagactctcctgtatagcctctggattcaccttcggcagttangctatgcacgtggggtccnccaggctccgaggcaaggggttgagtgggtgcagcaaatncatntgatggaatgataaatnttacatagagtccgtgaagggtcattcactatctacagagacaatcgacaaagaacacgactgtatcgtagaaactgaaccagcctagaggaggtgaacgtagtacgggttntttatacgtgacggcggacggggtaatacggagcttacgagtacggtaggaactaacaacgtttag

SEQ ID NO: 348177 - DNA, 536 bp, Homo sapiens
  misc_feature: GZ8MTXP02HCGRP.4.19.B08.1.454.CMB.2.raw
  modified_base (295)..(295): a, c, t, g, unknown or other
  misc_feature (295)..(295): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
  modified_base (391)..(391): a, c, t, g, unknown or other
  misc_feature (391)..(391): n is a, c, g, or t
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggagcgtggtccagcctgggagtccctgagactctcctgtatagcctctggattcaccttcggcagttatgctatgcacgtgggtcccnccaggctccgaggcgaaggggttggaggtggggtggcagcaatntcatangatggaatgaataaatatacatagagtcgagaaggtcatcacatcncagagacatcganaagacanactgtanctagaatgaccagcctagagaggtgaacgacgtacggggttatttacgttacgtggtacggacggtacggggtataggacggcttacgagttcggaggtaactacgtaaacgtttagg

SEQ ID NO: 348178 - DNA, 562 bp, Homo sapiens
  misc_feature: GZ8MTXP02II2QW.4.19.B08.1.454.CMB.2.raw
  modified_base (299)..(299): a, c, t, g, unknown or other
  misc_feature (299)..(299): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (417)..(417): a, c, t, g, unknown or other
  misc_feature (417)..(417): n is a, c, g, or t
  modified_base (449)..(449): a, c, t, g, unknown or other
  misc_feature (449)..(449): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggaggcgtggtccagccgtgggaggtccctgagactctcctgtatgcctctggattcaccttcggctagttatgctatgcacgtggggtcccnccgaggcctccgaggcgaaggggttggaggtggggtgcagcaatatcaatatgatggaagtgaataaatattacatagagtccgtaggaagggtcattcacntcncagagacatcganaaagacacactgtaatcgtaggaatcgaaccngcctaggaggtagggtcgaacggtacgtacgggtttattttagtacgtggtggaccggtcggggaaattgggacggtctacgagttcggtaggaacttaccgtaaagtttagg

SEQ ID NO: 348179 - DNA, 543 bp, Homo sapiens
  misc_feature: GZ8MTXP02IF78M.4.19.B08.1.454.CMB.2.raw
  modified_base (253)..(253): a, c, t, g, unknown or other
  misc_feature (253)..(253): n is a, c, g, or t
  modified_base (292)..(292): a, c, t, g, unknown or other
  misc_feature (292)..(292): n is a, c, g, or t
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
  modified_base (446)..(446): a, c, t, g, unknown or other
  misc_feature (446)..(446): n is a, c, g, or t
  modified_base (469)..(469): a, c, t, g, unknown or other
  misc_feature (469)..(469): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggagcgtggtccagcctgggagtccctgagactctctgtatagcctntggattcaccttcggcagttatgctatgcactgggtccnccaggctccgaggcaaggggttgaggtggggtgcagcaaatatcatatgatggaatgaataaatntacatagngtccgtagaagggtcattcaccatctaccagagacaatcgacaaagaacacactagtatctaggaaatgaccagcctgagnggtagacgaacgtacggggtttntttaatcgtgtacggacggtacgggtaagtaggacggtcgttacgacgttcggtagtaactaacgtaacgttag

SEQ ID NO: 348180 - DNA, 553 bp, Homo sapiens
  misc_feature: GZ8MTXP02FIJF6.4.19.B08.1.454.CMB.2.raw
  modified_base (295)..(295): a, c, t, g, unknown or other
  misc_feature (295)..(295): n is a, c, g, or t
  modified_base (326)..(326): a, c, t, g, unknown or other
  misc_feature (326)..(326): n is a, c, g, or t
  modified_base (336)..(337): a, c, t, g, unknown or other
  misc_feature (336)..(337): n is a, c, g, or t
  modified_base (341)..(341): a, c, t, g, unknown or other
  misc_feature (341)..(341): n is a, c, g, or t
  modified_base (373)..(373): a, c, t, g, unknown or other
  misc_feature (373)..(373): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggggaggcgtggtccagcctggggaggtccctgagactctcctgtatagcctctggattcaccttcggcagttatgctatgcactgggtccnccaggctccagacgaaggggttggagtgggngcagcaatannatangatggaagtgataaatattacatagagtccgngaagggtcattcacatctcagagacaatcgacaaagaacacaactgtaatcgtaggaaatcgaaccagcctaggagaggtgaacgacgtacggggttattttaacttacgtggtacgcgggacggggaataggaagggtcctacgtaacgttcgggtaggaactaaccgaaacgtttaag

SEQ ID NO: 348181 - DNA, 661 bp, Homo sapiens
  misc_feature: GZ8MTXP02H6ZEO.4.19.B08.1.454.CMB.2.raw
  modified_base (301)..(301): a, c, t, g, unknown or other
  misc_feature (301)..(301): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggaggcgtggtccagccgtggggagtccctgacgactctcctgtatagcctctggattcaccttcggctagttatgctatgcacgtcgggtcccnccgaggcctaccgaggtcggtaagggggttggaggtggggtggcagacaaatatcaattatgagtaggggtaaatagtaaattaaaaattacttacgaagttaaaggacggttacccggtaaggggtaaacgggggtctaactttacccaaccgtattccctaccgaaaggaacgtaaaccaaagtaccgaactaaaacgaaccaacgtaacgttagtaaactaccgttaagggaaaacctcgaaccgacgaccgtaggacgtaaggtagaacggtacggtacggttagtttactacgtggtacgcggacgggtataggacggtctacgacgtacggtaggaacttaaccaacgtttagg

SEQ ID NO: 348182 - DNA, 658 bp, Homo sapiens
  misc_feature: GZ8MTXP02FI86R.4.19.B08.1.454.CMB.2.raw
  modified_base (280)..(280): a, c, t, g, unknown or other
  misc_feature (280)..(280): n is a, c, g, or t
  modified_base (346)..(346): a, c, t, g, unknown or other
  misc_feature (346)..(346): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggagcgtggtccagcctgggacggtccctggagactctcctgtatagcctctggattcaccttcggctagttangctatgcacgtcgggtccgcgaggctccgaggcgtaagggggttggagtggggtgcgagcaagtancatatgatggaatagaataaatattacaataaggagttaccggtaggtaacggggtacgtaactttacccaacctaattccctacccgaaagaacgtaaaccaaaagttccgaacgaaaacgaaaacctacgtaaaccttaggtaaactttaccgaagggtaaaacttcggaaacccgaaggtcccgttaagggaaggtagggtacgaacggtacgttaacgggggttactttaagtttacgtggtacggcgggtacggggaactagggacggtcctacgtaacgtcggtaggaacttaacgtaactttagg

SEQ ID NO: 348183 - DNA, 566 bp, Homo sapiens
  misc_feature: GZ8MTXP02GXDBF.4.19.B08.1.454.CMB.2.raw
  modified_base (298)..(298): a, c, t, g, unknown or other
  misc_feature (298)..(298): n is a, c, g, or t
  modified_base (343)..(343): a, c, t, g, unknown or other
  misc_feature (343)..(343): n is a, c, g, or t
  modified_base (369)..(369): a, c, t, g, unknown or other
  misc_feature (369)..(369): n is a, c, g, or t
  modified_base (524)..(524): a, c, t, g, unknown or other
  misc_feature (524)..(524): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggaggcgtggtccagccgtgggaggtccctgagactctcctgtatagcctctggattcaccttcggctagttatgctatgcacgtgggtccnccgaggcctccgaggcgaaggggttggagtggggtgcagcaaatntcatatgataggaatgaataatatanatagagtcgtagaaggtcgattccgactatccacgagactacaatcgaacaaagacatactgtaatctaaggaaatcggaaccagccgtaggacgtaaggtgaacgacgtacgggttagtttaactacgtggtacggcgggtacggggataaggnggtcctggaacgttcggaggtaaactaacggtaaacgtttgg

SEQ ID NO: 348184 - DNA, 622 bp, Homo sapiens
  misc_feature: GZ8MTXP02JIX6D.4.19.B08.1.454.CMB.2.raw
  modified_base (253)..(253): a, c, t, g, unknown or other
  misc_feature (253)..(253): n is a, c, g, or t
  modified_base (275)..(275): a, c, t, g, unknown or other
  misc_feature (275)..(275): n is a, c, g, or t
  modified_base (294)..(294): a, c, t, g, unknown or other
  misc_feature (294)..(294): n is a, c, g, or t
  modified_base (373)..(373): a, c, t, g, unknown or other
  misc_feature (373)..(373): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggagcgtggtccagcctgggagtccctgagactctctgtatagcctntggattcaccttcggctagttngctatgctacgtggtcccnccgaggcctccgaggcgtaaggggttgaggtggggtcgcagcaagtatcatatgagtaggaatagaataaattacttanagtagtacggtccgtaggaagggtctaattaccacgtatcctacgagaacgtaacaagtcgaactaaacgaaacactacgtagttaactacgtaaggaaactcggaaacctacgaccgtaggaaggagggttacgaacggtacgtaacgggtttgttttaacttacgtacggttcggaaccggtacggggaaacgttacggaggtaacctccgtaagttacggtagaaacttaccgtaaactttaaggg

SEQ ID NO: 348185 - DNA, 544 bp, Homo sapiens
  misc_feature: GZ8MTXP02FRFVB.4.19.B08.1.454.CMB.2.raw
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
  modified_base (295)..(295): a, c, t, g, unknown or other
  misc_feature (295)..(295): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (357)..(357): a, c, t, g, unknown or other
  misc_feature (357)..(357): n is a, c, g, or t
  modified_base (391)..(391): a, c, t, g, unknown or other
  misc_feature (391)..(391): n is a, c, g, or t
  modified_base (411)..(411): a, c, t, g, unknown or other
  misc_feature (411)..(411): n is a, c, g, or t
  modified_base (463)..(463): a, c, t, g, unknown or other
  misc_feature (463)..(463): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggagcgtggtccagcctgggaggtccctgagactctcctgtatagcctntggattcaccttcggcagttangctatgcacgtgggtccncaggcctccgaggcaaggggttgagtggggngcagcaatncatangatggaatgaataaatntacagtagagtccgtagaagggtcattcacatcncagagacatcgacaagaacncactgtatcgtagaaatcgaccagcctgagaggtgaacgtacgtacgggttntttacgtacgtggtacgcggtacggggaatagggtaggccttacgaagttccggtaggtaaactaaccgtaacgtttaagg

SEQ ID NO: 348186 - DNA, 499 bp, Homo sapiens
  misc_feature: GZ8MTXP02FHZL5.4.19.B08.1.454.CMB.2.raw
  modified_base (276)..(276): a, c, t, g, unknown or other
  misc_feature (276)..(276): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (382)..(382): a, c, t, g, unknown or other
  misc_feature (382)..(382): n is a, c, g, or t
  modified_base (460)..(460): a, c, t, g, unknown or other
  misc_feature (460)..(460): n is a, c, g, or t
  modified_base (473)..(473): a, c, t, g, unknown or other
  misc_feature (473)..(473): n is a, c, g, or t
  modified_base (477)..(477): a, c, t, g, unknown or other
  misc_feature (477)..(477): n is a, c, g, or t
  modified_base (482)..(482): a, c, t, g, unknown or other
  misc_feature (482)..(482): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggggagcgtggtccagcctgggaggtccctgagactctcctgtatagcctctggattcaccttcggcagttangctatgcacgtgggtccgccaggctccaggcgaaggggttggagtgggtggcagcaatncatangatggaagtgaataaatattacatagagtccgtagaagggtnattcacatctcagagacaatcgacaagaacacactgtatctaggaaatgacagcctagagaggtgacgacgacgggtnttatactgtgcgnggangagcncgatcgagacacactag

SEQ ID NO: 348187 - DNA, 530 bp, Homo sapiens
  misc_feature: GZ8MTXP02JW54X.4.19.B08.1.454.CMB.2.raw
  modified_base (277)..(277): a, c, t, g, unknown or other
  misc_feature (277)..(277): n is a, c, g, or t
  modified_base (295)..(295): a, c, t, g, unknown or other
  misc_feature (295)..(295): n is a, c, g, or t
  modified_base (341)..(341): a, c, t, g, unknown or other
  misc_feature (341)..(341): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
  modified_base (453)..(453): a, c, t, g, unknown or other
  misc_feature (453)..(453): n is a, c, g, or t
tcagagcactgtagcacgaccggtgctcgatttagtgagtcagtaaggggtgggacgaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggagcgtggtccagcctgggagtccctgagactctcctgtatagcctctggattcaccttcggcagttangctatgcactggggtccnccaggcctccaggcaaggggttgagtgggtgcagcaaatatcatangatggaaagtgaataaaatattacattaggagttaccgagaaacggggttcaattcaacctaatcctacaagagacaaatcgacaaagacactacgntaaanctaggaaaanacacacgacagagagagacgacgacgtacgttatatgtgcgacgacgagagcgtacactacgtagacaacaactaag

SEQ ID NO: 348188 - DNA, 722 bp, Homo sapiens
  misc_feature: GZ8MTXP02HOSPW.4.19.B08.1.454.CMB.2.raw
  modified_base (305)..(305): a, c, t, g, unknown or other
  misc_feature (305)..(305): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggagcgtggtccagccgtggggagtccctgagactctctgtatagcctgtggattccaccttcggctagttatgctagtgacctacgtcggggtccccnccgtagggcccttaccggaaggggtccggtaaaggggggtttggggaggttggggggtacggcctaagggacaaaattacgtactaagttaagtggaagtaggggtaaagtagtaaaattaaaacgttattacgaagttaggtacggttacccggttaggggtaaacgggtctaaacttccaaccgtactccgtaaccgaagacgtaaacaacgtcgaaacaaacgaaacctactacgtagttaactacgttaaggaaaacttcggaaccctagtaccgtagaagggtacggtacggaacgtacgtacgggggttttatttacggttatacgggttggaaccgggtcgggtaaagtacgggaacgttccgtacgtaacgggttagtacgggaaactttaaccggtaaaagttttagg

SEQ ID NO: 348189 - DNA, 634 bp, Homo sapiens
  misc_feature: GZ8MTXP02I16KR.4.19.B08.1.454.CMB.2.raw
  modified_base (252)..(252): a, c, t, g, unknown or other
  misc_feature (252)..(252): n is a, c, g, or t
  modified_base (276)..(276): a, c, t, g, unknown or other
  misc_feature (276)..(276): n is a, c, g, or t
  modified_base (295)..(295): a, c, t, g, unknown or other
  misc_feature (295)..(295): n is a, c, g, or t
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggagcgtggtccagcctgggagtccctgagactctctgtatcgctntggattcaccttcggctagttacngctatgcacgtcgggtccnccgaggcctccgaggcgtaaggggttgaggtgggtgcagcaatncatangatggaagtgaataaattacttacagttaagacgttcgagaagggtcaattaccgactaattccacgaaagacgaacaataccggaacaaagtaaaccaacgtactagttaaatccgttaaggaaaactcggaaacccgaagtccgtaagaacgggaaggttacgaaaccggtacgtaaccggggtttattttaaactaccggttggacggtaccggggacgggtaaactaggggaaccggtcctacgtaaggttaccggtaggtaaacctaaaggttaacctttaaggg

SEQ ID NO: 348190 - DNA, 674 bp, Homo sapiens
  misc_feature: GZ8MTXP02I7QXV.4.19.B08.1.454.CMB.2.raw
  modified_base (276)..(276): a, c, t, g, unknown or other
  misc_feature (276)..(276): n is a, c, g, or t
  modified_base (295)..(295): a, c, t, g, unknown or other
  misc_feature (295)..(295): n is a, c, g, or t
  modified_base (340)..(340): a, c, t, g, unknown or other
  misc_feature (340)..(340): n is a, c, g, or t
  modified_base (370)..(370): a, c, t, g, unknown or other
  misc_feature (370)..(370): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtgactcgtgggggagcgtggtccagcctgggagtccctgagactctcctgtatagcctctggacttcaccttcggcagttangctatgcacgtgggtcccnccaggcctccgaggcgtaaggggtggagtggggtgcagctaagtntcatagtgagtggaagtgaattaaaacgtnttacagtaaggacgttaccgtaggaaacgggtcgtaacttaccgaacctactacctaccgaaggacgaaacaacgtacgacaaaagaaccaactacgtaggtaactacgtaaaggtaaacttggaaaccccgaagccccgttaaggaaggggtaacggttacgaaccgggaacggttaaccggggttttagttttaaacgttaccggttggtacgggtacccgggtacggggtaaacgtacgggtaacggggtccttacgtaaggttaccgggtaggtaaaacttaccgtaaaacggttttagg

SEQ ID NO: 348191 - DNA, 597 bp, Homo sapiens
  misc_feature: GZ8MTXP02HRIUA.4.19.B08.1.454.CMB.2.raw
  modified_base (275)..(275): a, c, t, g, unknown or other
  misc_feature (275)..(275): n is a, c, g, or t
  modified_base (294)..(294): a, c, t, g, unknown or other
  misc_feature (294)..(294): n is a, c, g, or t
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggagcgtggtccagcctgggagtcctgagctctcctgtatagcctctggattcaccttcggctagttangctatgccagtcgggtccnccgaggctccgagggcaaagggggtggaggtggggtgcaaggcaaagtatacatatgataggaagtanaactaaaattnttacaagttaaggacgttacccggttagggaaacgggtctaattaccaccaattccgacaggaagacaaacgcgaccaaaagaaccaaccaacttaggtaatacgttaggaaactcgaaccaagccgtagaagacggtgaccgtacgtacggggtttactttaagttatgtcggcgtacgggggataacggagtcacgtaacttcgaggtataactaagtttag

SEQ ID NO: 348192 - DNA, 806 bp, Homo sapiens
  misc_feature: GZ8MTXP02J2Z8G.4.19.B08.1.454.CMB.2.raw
  modified_base (248)..(248): a, c, t, g, unknown or other
  misc_feature (248)..(248): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttggctgagctgggtcttcctcgttgttctttaagaggtgtccagtgtcaggtgaaattggtggactcgtgggggagcgtggtccagccgtgggaggtccctgagactctcctgtanagcctctggacttcaccgttcggctagttatcgactatcgactacgtcgggtccgaccagggtccctaccggaagggtacggtaaagggggtttggaaggtggggtcggactaggtacaaattacgtacgtaatagtacggtaagttagggaaagttagtaaaattaaacgttaactttacgaagttaacgggtacggttaccggtaggaaagggggtttacctaattcccaaaccctagtaacccgtacccggaaaggtaaccgaaccgtaaagtcccggaaacaaaacgggtaacccaactaccgttagttaaacgtacgttaacgggaaaattacccggaaacccggtacgaccgggtttaaggaagggggttaacgggttacccggaaacgggtaaacccgggtttaaacggggtttttaggtttaaaccggttaaccggtcggggtttacggaaccgggggtacggggtaacgttaaaacggggcgggtaaccttacccggtaaaggttccggttaaaacgggacctttaaaacccggtaaacgttttagggg

SEQ ID NO: 348193 - DNA, 599 bp, Homo sapiens
  misc_feature: GZ8MTXP02GMS82.4.19.B08.1.454.CMB.2.raw
  modified_base (195)..(195): a, c, t, g, unknown or other
  misc_feature (195)..(195): n is a, c, g, or t
  modified_base (252)..(252): a, c, t, g, unknown or other
  misc_feature (252)..(252): n is a, c, g, or t
  modified_base (273)..(273): a, c, t, g, unknown or other
  misc_feature (273)..(273): n is a, c, g, or t
  modified_base (292)..(292): a, c, t, g, unknown or other
  misc_feature (292)..(292): n is a, c, g, or t
  modified_base (337)..(337): a, c, t, g, unknown or other
  misc_feature (337)..(337): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggnggactcgtgggggagcgtggtccagcctgggacgtcctgagactctctgtatgcctntggattcaccttggcagttangctatgcacgtgggtcccncaggctaccgaggcgaaggggttgaggtgggtggcagctaaatancaattatgaagttagggaaatgaaataaaactagttacattaagacgttaccgtagaaaggggtctaattaccaacctattccacagaacgaactaanccgaaanaaacaacactaacgttagtaactacgtaaagaactacgaacctagaccgtaggaacggtacggtacgaaacggtacgtacgggtttactttaacgtagtcggacggtcggaacgggtactaggacgtctacgagtacggtagaactaacgtaagttg

SEQ ID NO: 348194 - DNA, 736 bp, Homo sapiens
  misc_feature: GZ8MTXP02JCE69.4.19.B08.1.454.CMB.2.raw
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgtttgttcttttaagaggtgtccagtgtcaggtgtaaattggtggactcggtgggggaggcggtggtccagtccgtgggacggtccctgacgactctcctgtatagcctgtgacttcaccgttcggctagttatgtctagtcgccacgtcggggtcccaccgtaggcctaccgaggggtaccggtaagggggtttggaggttggggtggaccgaggactaaagtactacaagtttagacggtagtaggggaaacgttagtaaatttaaaaacgttactttaacgaagttaagggtaaaccgtttaccggggttaagggtaaaacgggggtttcgtaaactttacccgaaaccctacttacccgaaccgaagaaacgaaactaaacgaccgaaaccaaaagaacccaacttaaacgtcgtaactacgttaaggaaaactcggaaacccacgtaccggtagaaggtacggtacggaaccgtacgtaaacggggttttacgtttaacgttacgtcggtacggacgggtaacgggacgtaacggacgtctaagtacggcggtaagtaaacttaacgtaacgtttag

SEQ ID NO: 348195 - DNA, 605 bp, Homo sapiens
  misc_feature: GZ8MTXP02IF28Y.4.19.B08.1.454.CMB.2.raw
  modified_base (255)..(255): a, c, t, g, unknown or other
  misc_feature (255)..(255): n is a, c, g, or t
  modified_base (300)..(300): a, c, t, g, unknown or other
  misc_feature (300)..(300): n is a, c, g, or t
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
  modified_base (455)..(455): a, c, t, g, unknown or other
  misc_feature (455)..(455): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtgacgtcgtgggggaggcgtggtccagcctgggaggtccctgagactctctgtatagcctntggattcaccttcggctagttatgctatgcacgtggggtaccccncgagcctacggaggacggtaggggttggngggtcgggngcagactaatactagtatagagtaagtaggtaaagtagtaaacttaaaattacttagtaagttaaggtacggtacggtaagggacggttactacttaccactactacacgaacgaanacaacgtacaacaaacgacactactatacgtagtagaactcgacacgactaggacgaggtagacgtaacggtacggtttattagttagtcggtacggcggtacggagtacgacgtcgtacgtacgtacggtaagtactaacgtacgttag

SEQ ID NO: 348196 - DNA, 814 bp, Homo sapiens
  misc_feature: GZ8MTXP02GWMQ6.4.19.B08.1.454.CMB.2.raw
  modified_base (192)..(192): a, c, t, g, unknown or other
  misc_feature (192)..(192): n is a, c, g, or t
  modified_base (251)..(251): a, c, t, g, unknown or other
  misc_feature (251)..(251): n is a, c, g, or t
  modified_base (275)..(275): a, c, t, g, unknown or other
  misc_feature (275)..(275): n is a, c, g, or t
tcagagcactgtagcacgaccggtgctcgatttagtgagtcagtaaggggtgggagaggagcccagcactggaagtcgccggtgtttccattcggtgatcagcactgaacacagaggactcaccatggagtttggctgagctgggtcttcctgttgttctttaagaggtgtccagtgtcaggtgaaattggnggactcgtgggggagcgtggtccagcctgggagtccctgagactctcctgtatcgcctntggattccaccgttggctagttangctatgacacgtcgggtccaccaggcctccgagggacgtaagggggttgacgggttggggtacggcctaaggactaaaactagtaccaagttagtcggaagttaggggaaaagttagtaaaacctttaaaaattacgtttaaccgtaagttaacggggtaaaccggtttacccggtaaggggtaaaagggggttcctaaacgtttaacccgaaacccttaacgttaccgttaccccgaaagaaccggtaaacctaaaacgtccggaaaacctaaaaggaacccctaaacgtacgtttaacgtaaacttccggtaaaggggaaaacttaccgggaaccttaacggacccgtttaaggggaaccggtaaaggggttcggaaaacccggttaccgggtaaaccgggggtttttacttttaaaacgttccgggttacggttacggggaccggggttaccggggaaaacgttaccggggaaaggtcccgtttaccaaaggggttccggtaaagggtaaacctaacggttaaaaccgtttagggg

SEQ ID NO: 348197 - DNA, 582 bp, Homo sapiens
  misc_feature: GZ8MTXP01EFGY8.2.85.H08.1.454.CMB.2.raw
  modified_base (244)..(244): a, c, t, g, unknown or other
  misc_feature (244)..(244): n is a, c, g, or t
tcagacgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagcctgggtcctcggtgagggtctcctgcaaggcttctggaggcaccttcaggacctatattatgacctgggtncgacaggcccctggacaagggctgagtggcgtggggggatcgatccctatgtttggtgaaggctaaattacgacacgaaggaaagttccgggggaagagtctacgattaccccggcggacgaatcccaacgaaaccacaagacctacatggaagtcgaccagccctgagatcgtagaaagtaccgacgggtccgtagtattactggtagaccgtaaggttcgttaattacctatagatacgtggtagtattatttagtaatttcgaacttccttacacttacggtatggacgttcgttggggcccgagggaaccgacggtccaccgtcttcgtaaccg

SEQ ID NO: 348198 - DNA, 550 bp, Homo sapiens
  misc_feature: GZ8MTXP01A0MIA.2.85.H08.1.454.CMB.2.raw
  modified_base (331)..(331): a, c, t, g, unknown or other
  misc_feature (331)..(331): n is a, c, g, or t
  modified_base (455)..(455): a, c, t, g, unknown or other
  misc_feature (455)..(455): n is a, c, g, or t
  modified_base (493)..(493): a, c, t, g, unknown or other
  misc_feature (493)..(493): n is a, c, g, or t
tcagacgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagcctgggtcctcggtgagggtctcctgcaaggcttctggaggcaccttcaggacctatattatgacctgggtgcgacaggcccctggacaaggctgagtggcgtggggggatcatccctatgtttggtgaagcaaattacgcacagaagttccggggaanagtctcgattacccgctgacgaatccaacgaacaacagcctacatggaagtgaccagcctgagatctgaaacgacacggccgtagattactgtgacggaagtcgtattactatgatacgtggtntatttattgtaatttcgacttcctaccacgtaacggtnttcggttcgttcgtggggtacccgaagggggtacccacgggttccaaccgttctccg

SEQ ID NO: 348199 - DNA, 697 bp, Homo sapiens
  misc_feature: GZ8MTXP01EFPWH.2.85.H08.1.454.CMB.2.raw
  modified_base (219)..(219): a, c, t, g, unknown or other
  misc_feature (219)..(219): n is a, c, g, or t
tcagacgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagcctgggtcctcggtgagggtctcctgcaaggcttctggagcaccttnaggacctatattatgacctgggtgcgacaggcccctggacaagggctgagtggcgtggggggatcatccctatgtttggtgaagactaaaattacgacaacaaggtaaagttccgggggaaataggtctcgaacttaacccccggacggaaacgaaatacccaaaccgaaaacaacaacgaccctaaacaagttagggaaagtacggaaccaaacgccctaggaaagtatacgtaagaaacgaaccgtaccgggtacgtagttaacttacgtggtacgtacgtaaacgggttacgtttaaatttaactaagtagtaacttaacgttaggttagttaattttaatttacgttaaactttaccgtaaccttacccttaaacctaaccgttaaacggttagtacgggttacggttcgggttacgggggtaacccggaacgggggaacccgtacgggtacccttacccgttccgttccgtcg

SEQ ID NO: 348200 - DNA, 674 bp, Homo sapiens
  misc_feature: GZ8MTXP01CUIHK.2.85.H08.1.454.CMB.2.raw
  modified_base (242)..(242): a, c, t, g, unknown or other
  misc_feature (242)..(242): n is a, c, g, or t
tcagacgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagcctgggtcctcggtgagggtctcctgcaaggctctggagcaccttcaggacctatattatgacctgggtncgacaggcccctggacaaggctgagtggcgtggggggatcatcctagtgtttggtgaagcaaattacgacacagaaggttccggggaagagtctacgacttaccccggcggaacgaatacccaacggaaaacacaacggaccctaacgaacgtagggaaacgtcgaaccgaacggtacccttaggaacgtaagttcgtaggaaaacggaccgtaaaccgggtccgttaggttaacttaccgtagttacggacccggtaaagggtttacccgttaaagttttaacctaagttagtaattacgttggttagtaattttatttagtaactttcgtaaccttaccgttaacctacgttacggttagtcgggttaacgttcggttcggggaacccgaggggtaacccgtacgggtccaccgttccgttcgttaaccg

SEQ ID NO: 348201 - DNA, 605 bp, Homo sapiens
  misc_feature: GZ8MTXP01ALGLM.2.85.H08.1.454.CMB.2.raw
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
  modified_base (377)..(377): a, c, t, g, unknown or other
  misc_feature (377)..(377): n is a, c, g, or t
tcagacgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagcctgggtcctcggtgagggtctcctgcaaggcttctggagcaccttcaggacctatattatgacctgggtncaacgnggcccctggacaaggctgagtggcgtggggggatcatccctagtggtttggtgaagactaaacgttacgcagagaaggttccggggagagtctcgagttaccccgcggacgaatcccaacgaaacacncgacctaacgatggaagtcgacgagcctgagatacgtgaaagacgacgggtccgtaggtattacgtgtcgtacgaaaggttcgttaatttactagtagtattacgtggttagtatttagtttagtaactttcgaacttccgttaacgtacgttaaccggtatcgggttacgttcggttcggggaaccgacggggtaaccctacgggtccaccggttcttccgtaaccg

SEQ ID NO: 348202 - DNA, 653 bp, Homo sapiens
  misc_feature: GZ8MTXP01EUKJQ.2.85.H08.1.454.CMB.2.raw
tcagacgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagccgtgggtcctggtgagggtctccgtgcaaggcttcgtggaggcctaccttcaggtacctatattatgaccgtgggtgcgacgacggccccgtggacgaaggctgaggtggcgtggggggatcatccctagtgttggtagaagcaaattacgacacgaaggtaacggttaccgggggaaagtacgtcgtacgtacgttaccccggacggtaaacgaactacccgaaccgaaaaccaccaacgaccctaacgagtaggaagtcgaaccagcccgtagagatacgtagaaacgacgacggtccgttagtattaccgtgtcgacggtacggtagtttaagttactagtagtattacgtggttagttatttaagttagttaactttcgaacttaccttacctaacgttacggtagtcgggttaccgttcgggttacggggccggacgggaacgtaccggtaccgttacccgtccgttcgttcccg

SEQ ID NO: 348203 - DNA, 563 bp, Homo sapiens
  misc_feature: GZ8MTXP01CNA15.2.85.H08.1.454.CMB.2.raw
tcagacgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagcctgggtcctcggtgagggtctcctgcaaggcttctggaggcaccttcaggacctatattatgacctgggtgcgacaggcccctggacaagggctgagtggcgtggggggatcatccctatgtttggtgaagcaaattacgcacgagaagttccggggaagagtctcgattaccccgcggacgaagtccaacgaaaacacaacgacctaacgataggaatacgaccagccctagagatcgtagaaacgacaccgggccgtagtaattaccgtgtacgacgtaaaggttccgttaatttacgattagattacgtgtagtatttattgtaatttcgaacttcttactacttcgtatggacgttgttgggcagggccaggtcacgtcttcgtcg

SEQ ID NO: 348204 - DNA, 509 bp, Homo sapiens
  misc_feature: GZ8MTXP02GPQKD.2.85.H08.1.454.CMB.2.raw
tcagacgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagcctgggtcctcggtgagggtctcctgcaaggcttctggaggcaccttcaggacctatattatgacctgggtgcgacaggcccctggacaaggcttgagtggctggggggatcatcctatgttggtgaagcaaattacgcacagaagttccggggaagagtctcgattaccccgcggacgaatccacgaacacagcctacatgaagtgaccagacctgagatctagaagacacggcgtgtatactgtgcgaaatcgtattacgtatgatactgtgattattgaatttcgactctacactacgtatcgactcgtgggcagggaccacggcacgtctctc

SEQ ID NO: 348205 - DNA, 627 bp, Homo sapiens
  misc_feature: GZ8MTXP02H0TJS.2.85.H08.1.454.CMB.2.raw
  modified_base (241)..(241): a, c, t, g, unknown or other
  misc_feature (241)..(241): n is a, c, g, or t
  modified_base (300)..(300): a, c, t, g, unknown or other
  misc_feature (300)..(300): n is a, c, g, or t
  modified_base (333)..(333): a, c, t, g, unknown or other
  misc_feature (333)..(333): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
tcagacgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagccgtggtcctcggtgaggtctcctgcaaggcttctggaggcaccttcaggacctatattatgacctggngcgacaggcccctggacgaaggcttggagtggcgtgggggatcatccctagtgttggtnaagacaaagtacgcacaggaagttaccgggaanagtctagacgttacccgcgacgaataccacgaacacngcctaanagtaggaagtcgacagccgtagagatcagaacgtacgacggtccgtatacgttactgagcgtaagttcgttaattacgtatagtactagtggttagtattttagtttagaacgtttttaccgactttacccgtaacctaacgttaaccgggttaattcggggtaaccgtttccgggtacgggggtaacccgaaccgggggtaacccttacccggggtaccctacccgggtttccgtttcccttaacccgg

SEQ ID NO: 348206 - DNA, 540 bp, Homo sapiens
  misc_feature: GZ8MTXP02GZG1C.2.85.H08.1.454.CMB.2.raw
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
  modified_base (334)..(334): a, c, t, g, unknown or other
  misc_feature (334)..(334): n is a, c, g, or t
tcagacgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagcctgggtcctcggtgagggtctcctgcaaggcttctggaggcaccttnaggacctatattatgacctgggtncgacaggcccctggacaagggcttgagtggcgtggggggatcgatccctatgtttggtgaagcaaattacgcacagaagttccggggaanagtctacgattacccgcgacgaatccacgaacacagcctaacagtagaagtcgaccagcctagagatctagaaagacacggaccgtagtacttacgtgtagacgaagtcgtattacgtatagatacgtagtagtattattagatttcgactctacactacgtactcgacgtcgtgggccgagggacacggtacaccgtctactacg

SEQ ID NO: 348207 - DNA, 680 bp, Homo sapiens
  misc_feature: GZ8MTXP02HWSQN.2.85.H08.1.454.CMB.2.raw
  modified_base (241)..(241): a, c, t, g, unknown or other
  misc_feature (241)..(241): n is a, c, g, or t
tcagacgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagagcctggtcctcggtgaggtctcctgcaaggcttctggaggcaccttcaggacctatattatgacctgggtncgacaggcccctggacaaggcttgagtggcgtggggggatcgatcctagtgtttagggtgaaagctaaaagtttacgcaacgaggtaaacggtttaccggggaaagtaggtcctacggtaacttaccccggacgggaaccgaaatacccgaacggaaaccaacgacggacccttaacagttagggaaacgtcgaaccacgtcccgtgaagacttcgagaaacggtaacaccggggtaccttagtacgtttacgtggtagacgtaaacggttcgtttaaacttattagtacgtaagttagtggttagtatttaatttggtaaactttacgtaaccttcccttaaaccgtaacgttaacgggttacgtacgggtacgtacggtcggggtaaccgacgggggtaacgtaccgggtaccgacccgtttacgttccgttaaccg

SEQ ID NO: 348208 - DNA, 594 bp, Homo sapiens
  misc_feature: GZ8MTXP02G32MG.2.85.H08.1.454.CMB.2.raw
tcagacgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagcctgggtcctcggtgagggtctcctgcaaggcttctggaggcaccttcaggacctatattatgacctgggtgcgacaggcccctggacaagggctgagtggcgtggggggatcgatcccgtagtgtttggtgaagctaaaattacgcaacgaggaaggttaccggggaaagagtctacgtacttaccccggacggacgaactccgaacgaaccacacgacctaacagtaggaacgtcgaccgagccctagagatcgtagaacgacaccggcgtagtattacgtgtacgacgtaaggtcgttaattaacttagtagtaacttacgttggtagtatttagtttagtaatttcgtacttacctacacgttacgtagtacgacgtcgtacggggcgacgggaccgacggtcaccgttctactaccg

SEQ ID NO: 348209 - DNA, 823 bp, Homo sapiens
  misc_feature: GZ8MTXP02JYAW5.2.85.H08.1.454.CMB.2.raw
tcagacgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagcctgggtcctcggtgagggtctcctgcaaggcttctggaggcaccttcaggacctatattatgacctggtgcgacaggcccctggacaaggcttgagtggcgtggggggatcgatccctagttgttggtgaagctaaattacgcaacgaaggtaaacggttaccggggaaagtacgttcctacggtaacgtttacccccggacgggaacgaacgtacccaacgaaaccaaccacgaccctaaacgaacgttacgggaaagttacggaaacccgaaggacccgttaggaaacgtacgttacgtaaggaaaacggaccgtaacccggggtacccggtttaggttaaactttaccgtacgggttacgggtaaccggttaaaacggtttaccgggtttaaacttttaacccgtaaagtttacggtaaactttaaccggtttagggttaggtttaatttttaaagtttttacggttaaaacgtttttaccggtaaaccctttaccccgttaaacccgttaaccgtttaaaccgggttacgtttacggggtaacccggtttaccgggttaccgggggtaaccccggtaaaccgggggtaaccccgtaacccggggttaccccgtaaccccggtttccgtttacccgtttaaccccgg

SEQ ID NO: 348210 - DNA, 647 bp, Homo sapiens
  misc_feature: GZ8MTXP02F1Q13.2.85.H08.1.454.CMB.2.raw
tcagacgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagagcctgggtcctcggtgagggtctcctgcaaggcttctggaggcaccttcaggacctatattatgacctgggtgcgacacggcccctggacgaaggcttggagtggcgtgggggatcgatcccgtagtgtttggtagaagactaaagttacgacaacgaaggtaacggttaccggggaaagtacgtcgtacgtacgttaccccgacggaacgaaacgtacccaacgaaaccacacgccctaacagtaggaagtacgaaccagcctgagtatcgtagaagacgaccggtccgtagttattacgtgtagtacgaaagttacgttattactagtacgtaagttacgtaggttagtaatttattagtaactttacgtaacttacccttaactacgttaacggtacgtcggtaaccggttcggtacggggaacccgtaacgggggtaccctaccggggtactacccggttcgttacttacccg

SEQ ID NO: 348211 - DNA, 757 bp, Homo sapiens
  misc_feature: GZ8MTXP02GY5WZ.2.85.H08.1.454.CMB.2.raw
tcagacgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagctgggtcctcggtgagggtctcctgcaaggcttcgtggaggcaccttcaggacctatattatgacctgggtgcgacaggcccctggacaagggcttgagtgggcgtggggggatcgatccctagttgtttggtagaagactaaaagttacgacgaacgaggtaacggttacggggaaagtagtctacggtagttaccccggacggacgaactaccgaaccggaaaccaacacgacctaacgacgttaggaaagtcgaaccgagtaccctaggaacgtacgtaccgtaagaaacgtacccgtaccgggtacccgttagtttaaacgttaccgttggtaggtaaccggttaaacggttacggtttaacgtttaaccttaacgttagttaaaccgttaacggttaggggtttaatttaacgtttttaagtttttaggtaaaactttttccggtaaaccctttaacccgttaaacctaaaccggtttaaacgggtaacttacggggtaccgttaccggtacgggggtaacccggtaacgggggaacccgtaaccggtaccgttaacccgttccggttcctttaacccgg

SEQ ID NO: 348212 - DNA, 480 bp, Homo sapiens
  misc_feature: GZ8MTXP01BSWTE.45.37.D04.1.454.CMB.2.raw
  modified_base (308)..(308): a, c, t, g, unknown or other
  misc_feature (308)..(308): n is a, c, g, or t
  modified_base (348)..(348): a, c, t, g, unknown or other
  misc_feature (348)..(348): n is a, c, g, or t
  modified_base (399)..(399): a, c, t, g, unknown or other
  misc_feature (399)..(399): n is a, c, g, or t
  modified_base (405)..(405): a, c, t, g, unknown or other
  misc_feature (405)..(405): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
  modified_base (477)..(477): a, c, t, g, unknown or other
  misc_feature (477)..(477): n is a, c, g, or t
tcagacgcgatcgacacgaccggtgctcgatttagtagcatactgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctcaacaataagaactactagcttggtaccagcagaaaccaggtcagcctctaagctgctcatttacnggcatctaccggaatccggggtcccctgacgatcagtgcngcgggtctgggacagattcactctcaccatcagcagcctgcaggctgaagntgtggntagttatgcttganantatatatntctcttctcgttcgtcgtcgacgagagaatataacacgacgttagtgngtg

SEQ ID NO: 348213 - DNA, 510 bp, Homo sapiens
  misc_feature: GZ8MTXP01B3WYO.45.37.D04.1.454.CMB.2.raw
  modified_base (309)..(309): a, c, t, g, unknown or other
  misc_feature (309)..(309): n is a, c, g, or t
  modified_base (351)..(351): a, c, t, g, unknown or other
  misc_feature (351)..(351): n is a, c, g, or t
  modified_base (398)..(398): a, c, t, g, unknown or other
  misc_feature (398)..(398): n is a, c, g, or t
  modified_base (404)..(404): a, c, t, g, unknown or other
  misc_feature (404)..(404): n is a, c, g, or t
  modified_base (443)..(443): a, c, t, g, unknown or other
  misc_feature (443)..(443): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgtttagacagctcaacaataagaactactagcttggtaccagcagaaaccaggtcagcctcctaagctgctcatttacnggcatcgtacccggaatccggggtcccctgacgatcagtgcngcgggtctgggacagatttcactctcaccatcagcagcctgcaggcngaaagntggggtggctagtttattgctgtcagtcaattattattntaagttccttcgtatttccggcccttgggacccaagttggtaatataacaaacgtattgtggctaag

SEQ ID NO: 348214 - DNA, 515 bp, Homo sapiens
  misc_feature: GZ8MTXP01BKVHB.45.37.D04.1.454.CMB.2.raw
  modified_base (361)..(361): a, c, t, g, unknown or other
  misc_feature (361)..(361): n is a, c, g, or t
  modified_base (449)..(449): a, c, t, g, unknown or other
  misc_feature (449)..(449): n is a, c, g, or t
  modified_base (486)..(486): a, c, t, g, unknown or other
  misc_feature (486)..(486): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacacctcaccggcgactatctccactgggtgcgacaggcccctggacaagggcttgagtggatggggatggatcgaaaccccctaacaatggtggcaaacaaactntgcacagaagtttcagggcagggtcaccatgaccagggacacgtccatcagcacagcctacagtggagctgagccaagactgacatcngacgacaccggcctatttattacgttgttgcgaggtnttggttaccgggttgtcgttggttttccg

SEQ ID NO: 348215 - DNA, 531 bp, Homo sapiens
  misc_feature: GZ8MTXP01DTK1Y.45.37.D04.1.454.CMB.2.raw
  modified_base (364)..(364): a, c, t, g, unknown or other
  misc_feature (364)..(364): n is a, c, g, or t
  modified_base (411)..(411): a, c, t, g, unknown or other
  misc_feature (411)..(411): n is a, c, g, or t
  modified_base (429)..(429): a, c, t, g, unknown or other
  misc_feature (429)..(429): n is a, c, g, or t
  modified_base (440)..(440): a, c, t, g, unknown or other
  misc_feature (440)..(440): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctgggggcctcagtgaaggtctcctgcaaggcttctggctacacctcaccggcgactatctccactgggtgcgacacggcccctggacaagggcttgagtggatgggatggatcaaacccctaacaaagtggtaggcaaacaaaactntgcaacagaagtttcaggggcagggtcacatgacagggacacgtcanacacgcaacagccctaanagtggaacgcngagcaagactgaacatctgaacgacacggccctaatttacttacgttgttgcgaggtcttcgggtttaccggttggtcgttggttttcccg

SEQ ID NO: 348216 - DNA, 604 bp, Homo sapiens
  misc_feature: GZ8MTXP01DW3HT.45.37.D04.1.454.CMB.2.raw
  modified_base (365)..(365): a, c, t, g, unknown or other
  misc_feature (365)..(365): n is a, c, g, or t
  modified_base (420)..(420): a, c, t, g, unknown or other
  misc_feature (420)..(420): n is a, c, g, or t
tcagacgcgatcgacacgaccggtgctcgatttagtagcatactgttggggtttgggggcatcacccagcaaccacatctgtcctctagagaatcccctgagagctccgttcctcaccatggactggacctggaggatcctcttcttggtggcagcagccacaagagcccactccccaggtgcagctggtgcagtctgggggctgaggtgaggaagcctgggggcctcagtgaaggtctcctgcaaggcttctggctacaccttcaccggcgactatctccactgggtgcgacaggccccctggacaaggggcttgagtggatgggatggatcaaacccctaaacagtggagacaacaaaactangacaacaagtaagttacgagggacgacggtacacatacgacgaggacacgtacancagacacacgacctacgagtaggacgcgtagacgacgaagtaacgtacgacactacgtacgaacgaaccgaaccggtaccgttaacgtttaacgtttaacgttacggttcggttacgggtaagggtacggtttaacgggtttaccgggttacgggttcggtttcgggttttccggttttaacgg

SEQ ID NO: 348217 - DNA, 514 bp, Homo sapiens
  misc_feature: GZ8MTXP01DXSCO.45.37.D04.1.454.CMB.2.raw
  modified_base (459)..(459): a, c, t, g, unknown or other
  misc_feature (459)..(459): n is a, c, g, or t
  modified_base (494)..(494): a, c, t, g, unknown or other
  misc_feature (494)..(494): n is a, c, g, or t
tcagacgcgatcgacacgaccggtgctcgatttagtagcatactgttggggtttgggggcatcaccccagcaaccacatctgtcctctagagaatcccctgagagctccgttcctcaccatggactggacctggaggatcctcttcttggtggcagcagccacaagagccccactccccaggtgcagctggtgcagtctgggggctgaggtgaggaagcctgggggcctcagtgaaggtctcctgcaaggcttctggctacaccttcaccggcgactatctccactggggtgcgacaggccccctggacaaggggcttgagtggatggggatggatcaaacccctaaccaatggtggcacaaaactatgcacagaagtttcaggggcagggtcaccatgaccagggacacgtcatcagcacagcctacatggagctgagcagactgacatctgaacganacggcttattatacttgttgcgaagatgttacggngttcgttggttccgttttgg

SEQ ID NO: 348218 - DNA, 513 bp, Homo sapiens
  misc_feature: GZ8MTXP01C74W3.45.37.D04.1.454.CMB.2.raw
  modified_base (359)..(359): a, c, t, g, unknown or other
  misc_feature (359)..(359): n is a, c, g, or t
  modified_base (431)..(431): a, c, t, g, unknown or other
  misc_feature (431)..(431): n is a, c, g, or t
  modified_base (467)..(467): a, c, t, g, unknown or other
  misc_feature (467)..(467): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctgggggcctcagtgaaggtctcctgcaaggcttctggctacacctcaccggcgactatctccactgggtgcgacaggcccctggacaagggcttgagtggatgggatggatcaaccccctaacaatggtggcaacaaactntgcacagaagtttcagggcagggtcaccatgacagggacacgtcatcagcacagcctacatcggagctggancaagactgacactctaagacgacacggcctaatttnttaccttgttgcgaggaatggtttaccggttgtcgttggttttccg

SEQ ID NO: 348219 - DNA, 494 bp, Homo sapiens
  misc_feature: GZ8MTXP01DWLXV.45.37.D04.1.454.CMB.2.raw
  modified_base (242)..(242): a, c, t, g, unknown or other
  misc_feature (242)..(242): n is a, c, g, or t
  modified_base (279)..(279): a, c, t, g, unknown or other
  misc_feature (279)..(279): n is a, c, g, or t
  modified_base (412)..(412): a, c, t, g, unknown or other
  misc_feature (412)..(412): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgtagctggtgcagtctggggctgaggtgaggagcctgggcctcagtgagtctctgcagctntggctacaccttcaccggcgactatctccactgggtncgacaggcccctggacaagggcttgagtggatgggatggatcaacctaacaatggtggcacaaaaactatgcacagaagttcagggcagggtcacatgacagggacacgtccatcagcacagcctacatgganctgagcagactgacatctgaacgacacggccagtttatacttgttgcgaaggatgtttaccggtggctggtttcgttttcgg

SEQ ID NO: 348220 - DNA, 577 bp, Homo sapiens
  misc_feature: GZ8MTXP01CJSQ2.45.37.D04.1.454.CMB.2.raw
  modified_base (379)..(379): a, c, t, g, unknown or other
  misc_feature (379)..(379): n is a, c, g, or t
  modified_base (434)..(434): a, c, t, g, unknown or other
  misc_feature (434)..(434): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagcgtggtgcagtcgtggggctggaggtgaggaagccgtgggcctcgagtgagtctctgcagcttcgtggctacacctcgaccggcgactatcctccacgtgggtcgcgacacggccccctggaacgaagggtcttggaggtggagtgggatggataccaaaccccctaacgaagtgggtggaccaaaaccaaactntcgacaacgagtaacgttcgagggcgagggtcacatcgaccgagggacacgtcancgagcaacacgcctaacagtggagtcgagacgcgaacggctacggactacttcgaaggaacgaccgaccggaccgtaattttacttacgttgttcgcgtaggtctttcggtttacccgggttgttcgtttcggtttttcccgg

SEQ ID NO: 348221 - DNA, 521 bp, Homo sapiens
  misc_feature: GZ8MTXP01CBATE.45.37.D04.1.454.CMB.2.raw
  modified_base (287)..(287): a, c, t, g, unknown or other
  misc_feature (287)..(287): n is a, c, g, or t
  modified_base (448)..(448): a, c, t, g, unknown or other
  misc_feature (448)..(448): n is a, c, g, or t
tcagacgcgatcgacacgaccggtgctcgatttagtagcatactgttgggtttggggcatcacccagcaaccacatctgtcctctagagaatcccctgagagctccgttcctcaccatggactggacctggaggatcctcttcttggtggcagcagccacaagagccccactccccaggtgcagctggtgcagtctggggctgaggtgaggaagcctggggcctcagtgaaggtctcctgcaaggcttctggctacaccttcaccggcgactatctccactggggtncgacacggccccctggacaagggcttgagtggatgggatggatcaaccctaacaatggtggcacaaaactatgacaacagtaagtttcgagggcagggtcacatgaccagggacacgtccatcagcacagacctacgatggagctgagcagactgacatcngaacgcacggcttagtttatcttgttgcgaaggtattcggtttaccggtggttcgttgggtttccttttcggg

SEQ ID NO: 348222 - DNA, 580 bp, Homo sapiens
  misc_feature: GZ8MTXP01ATYAQ.45.37.D04.1.454.CMB.2.raw
tcagacgcgatcgacacgaccggtgctcgatttagtagcatactgttggggtttgggggcatcacccagcaaccacatctgtcctctagagaatcccctgagagctccgttcctcaccatggactggacctggaggatcctcttcttggtggcagcagccacaagagccccactccccaggtgcagctggtgcagtctggggctgaggtgaggaagcctgggggcctcagtgaaggtctcctgcaaggcttctggctacaccttcaccggcgactatctccactggggtgcgacacggccccctggacaagggggctttggagtgggagtgggggatggatcaaacccctaaccaagtggtggacacgaaaaaactatgcaacagaagtttcgaggggcagggtcacatgaccgagggacacgtccatcagcacagcctacgatggagctgagcagacctgaccatcctgaaccgacacggtcccttaagtttacttaacgttgttggaccggtaaggggtactttaacgggtttaacccggggttgggttccgtttcgggtttccgtttttaaccgggg

SEQ ID NO: 348223 - DNA, 592 bp, Homo sapiens
  misc_feature: GZ8MTXP01C2DKK.45.37.D04.1.454.CMB.2.raw
  modified_base (320)..(320): a, c, t, g, unknown or other
  misc_feature (320)..(320): n is a, c, g, or t
  modified_base (385)..(385): a, c, t, g, unknown or other
  misc_feature (385)..(385): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctaccaaacaataagaactactagcttaggtaccagcaagaaaccaggtcagcctacctaagctgctactattttacgnggacagtccgtaacccggggaactcccgggggtcccccctaggaccgtattccgaaggtcgggcnggcgggtcgtggggacaggtactttcactctacaccatcagcacgcctgcgagctagaagatggggtggtctagtttatggtcctgtcaagtactaaattattaattataactttccccgttaccgtacgttttccggacccgttaggggaacccttaaaggttcggtaactaacgtaaccgaaaacgtaacgttgttcggctaacg

SEQ ID NO: 348224 - DNA, 551 bp, Homo sapiens
  misc_feature: GZ8MTXP01CW6KX.45.37.D04.1.454.CMB.2.raw
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagccccactcccaggtgcagctggtgcagtctggggctgaggtgaggagcctggggcctcagtgaaggtctcctgcaaggcttctggctacaccttcaccggcgactatctccactgggtgcgacacggccccctggacaagggcttgagtggatgggatggactcaacccctaacaagtggtgacacaaaaactatgcacgagtaagtttcgagggcacgggtcacatgacaggacacgtcatcacgcacagcctacgagtggagcgtagagcgagactcgactagtctgaacgaccgacggaccttagtttaacttacttggttcgcggtaaggtacgttcgggtttaacccgggtggttacgtttcggtttccgtttttaacgg

SEQ ID NO: 348225 - DNA, 634 bp, Homo sapiens
  misc_feature: GZ8MTXP01D47P6.45.37.D04.1.454.CMB.2.raw
  modified_base (250)..(250): a, c, t, g, unknown or other
  misc_feature (250)..(250): n is a, c, g, or t
  modified_base (284)..(284): a, c, t, g, unknown or other
  misc_feature (284)..(284): n is a, c, g, or t
  modified_base (367)..(367): a, c, t, g, unknown or other
  misc_feature (367)..(367): n is a, c, g, or t
  modified_base (408)..(408): a, c, t, g, unknown or other
  misc_feature (408)..(408): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagcgtggggcctgagtgaaggtctctgacagcttcngctacactcgacggctattactctccacgtgggncgacgacggcccctggacgaagggtcttagagtggagtggatggatccaaaccccctaacaagtggtagacaaaactaaactntgacaacgaagtaagtttcgagggaccagggtcaaccgtanacggaaccgaggggaaccacggttaccaacgtacacgacaacgacgacccgttaacaaggttccgggaaacgtcgtagacgacgtaacgacgtacgaactacgtccggaacgaaccgaaccgtacccggttactttaaacgttttacgttacgttggttacggtaacgggttaggttaacggtttacggggttaccgggttcggtttccgttttcgggtttttccg

SEQ ID NO: 348226 - DNA, 521 bp, Homo sapiens
  misc_feature: GZ8MTXP01D70AU.45.37.D04.1.454.CMB.2.raw
  modified_base (250)..(250): a, c, t, g, unknown or other
  misc_feature (250)..(250): n is a, c, g, or t
  modified_base (451)..(451): a, c, t, g, unknown or other
  misc_feature (451)..(451): n is a, c, g, or t
  modified_base (501)..(501): a, c, t, g, unknown or other
  misc_feature (501)..(501): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctgggggcctcagtgaaggtctcctgcaaggcttcnggctacaccttcaccggcgactatctccacgtgggtgcgacacgggccccctggacgaagggcttgagtggatgggatggatcgaaccctaacaatggtgcaacaaaactatgacacagagtttcaggggcagggtcacatgaccgagggacacgtcatcagcacagacctacgagtggacgctagagcagactgacatcngaacgacgacggcttatttatacttgttcgacgaaggtatcgtttacggngttcgttcggtttcgtttgg

SEQ ID NO: 348227 - DNA, 527 bp, Homo sapiens
  misc_feature: GZ8MTXP01EBZCZ.45.37.D04.1.454.CMB.2.raw
  modified_base (366)..(366): a, c, t, g, unknown or other
  misc_feature (366)..(366): n is a, c, g, or t
  modified_base (455)..(455): a, c, t, g, unknown or other
  misc_feature (455)..(455): n is a, c, g, or t
  modified_base (493)..(493): a, c, t, g, unknown or other
  misc_feature (493)..(493): n is a, c, g, or t
  modified_base (506)..(506): a, c, t, g, unknown or other
  misc_feature (506)..(506): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcagtgaaggtctcctgcaaggcttctggctacacctcaccggcgactatctccactgggtgcgacaggcccctggacaagggcttgagtggagtgggatggatcaaaccccctaacaagtggtaggacaaacaaaactntgacaacagtaagtttcgagggtcagggtcaccatgaccaggacacgtcatcagtacagcctacatggagctgagcagactgacatcgngaacacgacggccttatttataacttgttgcgaaggtntcggtttaccggnggttcttggtttcgttttcgg

SEQ ID NO: 348228 - DNA, 525 bp, Homo sapiens
  misc_feature: GZ8MTXP01DV1J6.45.37.D04.1.454.CMB.2.raw
  modified_base (249)..(249): a, c, t, g, unknown or other
  misc_feature (249)..(249): n is a, c, g, or t
  modified_base (469)..(469): a, c, t, g, unknown or other
  misc_feature (469)..(469): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
  modified_base (508)..(508): a, c, t, g, unknown or other
  misc_feature (508)..(508): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggtttcnggctacaccttcaccggcgactatctccactgggtgcgacacggcccctggacaaggggcttgagtggatgggatggatacaaaccctaacaacgtggtaggacaacaaactaatgcaacgaagtaaagtttccgaggggcaaggggtaccaccatcgaaccgagggacacgtaccatacagacacagacctacagtggagctgagcagtacagacatcngacgaacacgctattatactgttgngagntgttaaccgngtcttgttctttgaacg

SEQ ID NO: 348229 - DNA, 519 bp, Homo sapiens
  misc_feature: GZ8MTXP01B6HHV.45.37.D04.1.454.CMB.2.raw
  modified_base (359)..(359): a, c, t, g, unknown or other
  misc_feature (359)..(359): n is a, c, g, or t
  modified_base (491)..(491): a, c, t, g, unknown or other
  misc_feature (491)..(491): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacacctcaccggcgactatctccactgggtgcgacaggcccctggacaaggggcttgagtggatgggatggatcaaccccctaacaatggtggcaaacaaactntgcacagaagtttcagggcagggtcaccgatgaccagggacacggtccatcagcacagccgtacagtggagctgagccaagacgtagacctatctgaacgacgacggccctatttattacttgttgcggagnttgttacggttcggtcgttggttttccg

SEQ ID NO: 348230 - DNA, 544 bp, Homo sapiens
  misc_feature: GZ8MTXP01DYV3W.45.37.D04.1.454.CMB.2.raw
  modified_base (439)..(439): a, c, t, g, unknown or other
  misc_feature (439)..(439): n is a, c, g, or t
  modified_base (460)..(460): a, c, t, g, unknown or other
  misc_feature (460)..(460): n is a, c, g, or t
tcagacgcgatcgacacgaccggtgctcgatttagtagcatactgttgggttttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggagcctggggcctcagtgaaggtctcctgcaggcttctggctacacctcaccggcgactatctccacgtgggtgcgacacggcccctggacaagggcttgagtggatgggatggactcaaaccccctacaagtggtagacaaacaaactgtgacacagtaacgttcgagggcagggtcacagtacgaccgagggacacgtaccatcagcactacgctacagtggancgtgagccaagactgaacctntcgaagacgaccgacgttcctaatttattacgttgttcggcgaggtcgttcggttaccggttggtcgtttcggttttaacccgg

SEQ ID NO: 348231 - DNA, 569 bp, Homo sapiens
  misc_feature: GZ8MTXP01CWKZW.45.37.D04.1.454.CMB.2.raw
  modified_base (314)..(314): a, c, t, g, unknown or other
  misc_feature (314)..(314): n is a, c, g, or t
  modified_base (353)..(353): a, c, t, g, unknown or other
  misc_feature (353)..(353): n is a, c, g, or t
  modified_base (373)..(373): a, c, t, g, unknown or other
  misc_feature (373)..(373): n is a, c, g, or t
  modified_base (409)..(409): a, c, t, g, unknown or other
  misc_feature (409)..(409): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagacgggccacatcaactgacaagtccagccagagtgtttagacagctacaaacaataagaactactagcttggtaccagcaagaaaccaggtcagcctctaagctgctcatttacgnggactacgtccgtaccggtacgtccggtccctagacgtntcgagtcgcgcggtcggtgnggacagtacttcactcacaccatacgagcacgtccngacgagagtagaagtgtggggtgtactttagttagtcgtcgtagtacgaagtactaaattattacttacgttaacccttccgttaccgttaccgttccggacccgtaagggaacgttaaggttacgtaactaacgtaacgaaacgtgttacgtcgcgtcg

SEQ ID NO: 348232 - DNA, 494 bp, Homo sapiens
  misc_feature: GZ8MTXP01CEG7C.45.37.D04.1.454.CMB.2.raw
  modified_base (338)..(338): a, c, t, g, unknown or other
  misc_feature (338)..(338): n is a, c, g, or t
  modified_base (420)..(420): a, c, t, g, unknown or other
  misc_feature (420)..(420): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
  modified_base (461)..(461): a, c, t, g, unknown or other
  misc_feature (461)..(461): n is a, c, g, or t
  modified_base (472)..(472): a, c, t, g, unknown or other
  misc_feature (472)..(472): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacacctcaccggcgactatctccactgggtgcgacaggcccatggacaagggcttgagtggatgggatggatccgaaccctanaatggtggacacaactatgcacagaagttcagggcagggtcacatgaccagggacacgtccatcagcacaggctacatggancngagcagactgacntctgacgacacggcctatttattacngtgcgaaggtntggttaccggtggcgtttcggg

SEQ ID NO: 348233 - DNA, 533 bp, Homo sapiens
  misc_feature: GZ8MTXP01BBIS4.45.37.D04.1.454.CMB.2.raw
  modified_base (364)..(364): a, c, t, g, unknown or other
  misc_feature (364)..(364): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggagcctggggcctcagtgaaggtctcctgcaaggcttctggctacacctcaccggcgactatctccactgggtgcgacacggcccctggacaagggcttgagtggatgggatggatcgaaaccccctaacaaagtggtaggcaaacaaactntgacacagaagtttcgaagggtcagggtcacatgaccagggacacgtcatcagcacagctacagtggagctgagccaagacctagacatctaagaccgacaccgggcctaagtttaacttacgttgttgcggagtaagttcggttacggttggtcgtttggttttcccg

SEQ ID NO: 348234 - DNA, 552 bp, Homo sapiens
  misc_feature: GZ8MTXP01DIOXK.45.37.D04.1.454.CMB.2.raw
  modified_base (227)..(227): a, c, t, g, unknown or other
  misc_feature (227)..(227): n is a, c, g, or t
  modified_base (356)..(356): a, c, t, g, unknown or other
  misc_feature (356)..(356): n is a, c, g, or t
  modified_base (529)..(529): a, c, t, g, unknown or other
  misc_feature (529)..(529): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctggaggtgaggagcctggggcctnagtgaaggtctcctgcaaggcttctggctacacctcaccggcgactatctccactgggtgcgacaggcccctggacaaggggcttgagtggatgggatggatcaacccctacaatggtgcaacaaactntgcaacagaagtttcaggggcagggtcaccatgaccagggacacgtcatcagcacagcctacagtggagctgacgacaaggacctaggacacgtctaaggacgaccgaccgggttcctaattttaacttaccgttggttacgaacggtagggtaagttcgggtttacccgggngggttccgttcgggtttttcccg

SEQ ID NO: 348235 - DNA, 556 bp, Homo sapiens
  misc_feature: GZ8MTXP01AIQ22.45.37.D04.1.454.CMB.2.raw
  modified_base (339)..(339): a, c, t, g, unknown or other
  misc_feature (339)..(339): n is a, c, g, or t
  modified_base (358)..(358): a, c, t, g, unknown or other
  misc_feature (358)..(358): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacacctcaccggcgactatctccactgggtgcgacacggcccctggacaagggcttgagtggatgggatggatcaaccccctaanaatggtggcaaacaaactntgcacagtaagtttcgaggggtcagggtacaccagtacgaccgagggaccacgtccagtcagacacacgcctacagtcggacgctggacgcaaggacctgactatcgtaagaccgacgaccggttcctaatttacttacgttggttcgcggtaggtaagttcgggtttacccggggttggtcgtttcgggttttccgg

SEQ ID NO: 348236 - DNA, 505 bp, Homo sapiens
  misc_feature: GZ8MTXP01CVUT6.45.37.D04.1.454.CMB.2.raw
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctaccaacaataagaactactagcttggtaccagcagaaaccaggtcagcctctaagctgctcatttactggcatctaccggatccggggtcccctgacgntcagtgcngcgggtctgggacagatttcactctcaccatcagcagcctgcaggctagaagatggtggctagtttatgctgtcagctaatattattataacttccttcgtactttccggcctgggaaccttaagttcggaatataacaaacgacttgtcgctcg

SEQ ID NO: 348237 - DNA, 541 bp, Homo sapiens
  misc_feature: GZ8MTXP01EI6XF.45.37.D04.1.454.CMB.2.raw
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
  modified_base (363)..(363): a, c, t, g, unknown or other
  misc_feature (363)..(363): n is a, c, g, or t
  modified_base (417)..(417): a, c, t, g, unknown or other
  misc_feature (417)..(417): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
  modified_base (441)..(441): a, c, t, g, unknown or other
  misc_feature (441)..(441): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggagccgtggggcctnagtgaggtctctgcaagcttcnggctacacctcaccggcgactatctccacgtgggtgcgacacggcccctggacaagggcttgagtggagtgggatggataccaaaccccctaacaagtggtggacaaacaaactntgacaacgagtaagtttcgagggtcagggtcacagtcgacgagggacacgtcancagcacacgcctanagtggancgngacgacaagactgactatcgtaagaacgacacggttacctatttacttacgttgttgcggagtaagttcggttaccgggttggttcgtttcggttttccg

SEQ ID NO: 348238 - DNA, 522 bp, Homo sapiens
  misc_feature: GZ8MTXP01ARCPC.45.37.D04.1.454.CMB.2.raw
  modified_base (293)..(293): a, c, t, g, unknown or other
  misc_feature (293)..(293): n is a, c, g, or t
  modified_base (497)..(497): a, c, t, g, unknown or other
  misc_feature (497)..(497): n is a, c, g, or t
tcagacgcgatcgacacgaccggtgctcgatttagtagcatactgttggggtttgggggcatcaccccagcaaccacatctgtcctctagagaatccccctgagagctccgttcctcaccatggactggacctggaggatcctcttcttggtggcagcagccacaagagcccactccccaggtgcagctggtgcagtctgggggctgaggtgaggaagcctgggggcctcagtgaaggtctcctgcaagggcttctggctacaccttcaccggcgactatctccactggggtncgacaggccccctggacaaggggcttggagtggatggggatggatcaacccctaacaatggtggcacaaaactatgcacagagtttcaggggcagggtcacatgaccagggacacgtcatcagcacagcctagatggagctgagcagactgacatctgaacgacacggccatttatacgttgttgcggtaagagtcgttacggnggttacttcggttcgttttaacggg

SEQ ID NO: 348239 - DNA, 520 bp, Homo sapiens
  misc_feature: GZ8MTXP01C1R6X.45.37.D04.1.454.CMB.2.raw
  modified_base (363)..(363): a, c, t, g, unknown or other
  misc_feature (363)..(363): n is a, c, g, or t
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctgaggtgaggaagccgtgggggcctcagtgaaggtctcctgcaaggcttctggctacacctcaccggcgactatctccactgggtgcgacaggcccctggacaagggctgagtggagtgggatggatcaaaccccctaacaaatggtggcaaacaaactntagacaacagaagtttcgagggcgagggtcaccatgacagggacacgtcatcagcacacgctacatggagcngancagactgaccatctgacgacacggcctattacttacgttgttcgcgaggtcttggttaccggttgtcgttcggttttaaccg

SEQ ID NO: 348240 - DNA, 508 bp, Homo sapiens
  misc_feature: GZ8MTXP01EZSNE.45.37.D04.1.454.CMB.2.raw
  modified_base (312)..(312): a, c, t, g, unknown or other
  misc_feature (312)..(312): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
  modified_base (441)..(441): a, c, t, g, unknown or other
  misc_feature (441)..(441): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaaacaataagaactactagcttggtaccagcagaaaccaggtcagcctctaagctgctcatttacnggcatctacccggatccggggtcccctgacgatcagtggcngcgggtntgggacagtatttcactctcaccatcagcagcctgcaggctgaagatgggtgcagtttatgctgtcagctaatatattatnttccttccgtactttcggccgttacggaccgaaagttcggtaatataacaaacgtacttgtggctcg

SEQ ID NO: 348241 - DNA, 505 bp, Homo sapiens
  misc_feature: GZ8MTXP01BUOY3.45.37.D04.1.454.CMB.2.raw
  modified_base (228)..(228): a, c, t, g, unknown or other
  misc_feature (228)..(228): n is a, c, g, or t
  modified_base (337)..(337): a, c, t, g, unknown or other
  misc_feature (337)..(337): n is a, c, g, or t
  modified_base (354)..(354): a, c, t, g, unknown or other
  misc_feature (354)..(354): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctnagtgaaggtctcctgcaaggcttctggctacaccttcaccggcgactatctccactggtgcgacaggcccctggacagggcttgagtggatgggatggatccaacctanaatggtgacaacaactntgcacagtaagtttcagggcagggtcacatgacgagggacacgtccatcagcacaggcctacagtaggagctgagcagtactagacatctgacgacacggtcctatttattcttgtgcgtaaggtattggttaccggtggttcgttttcgg

SEQ ID NO: 348242 - DNA, 492 bp, Homo sapiens
  misc_feature: GZ8MTXP01EG2F2.45.37.D04.1.454.CMB.2.raw
  modified_base (337)..(337): a, c, t, g, unknown or other
  misc_feature (337)..(337): n is a, c, g, or t
  modified_base (419)..(419): a, c, t, g, unknown or other
  misc_feature (419)..(419): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (459)..(459): a, c, t, g, unknown or other
  misc_feature (459)..(459): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacagggctgagtggatggatggatccaacctaanaatggtgacacaactatgcacagaagttcagggcagggtcacatgacagggacacgtcatcagcacgaggcctacatgggancgtgagcagctgacntcngacgacacggctatttagttcngtgcgaagtagtcggttacgtggttcgtttcgg

SEQ ID NO: 348243 - DNA, 571 bp, Homo sapiens
  misc_feature: GZ8MTXP01CHQOJ.45.37.D04.1.454.CMB.2.raw
  modified_base (315)..(315): a, c, t, g, unknown or other
  misc_feature (315)..(315): n is a, c, g, or t
  modified_base (379)..(379): a, c, t, g, unknown or other
  misc_feature (379)..(379): n is a, c, g, or t
  modified_base (501)..(501): a, c, t, g, unknown or other
  misc_feature (501)..(501): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccacatcaactgcaagtccagccagagtgtttagacagctacaacaataagaactactagcttaggaccagcaagaaaccaggtcagccctacaagctgctactatttacgngggacactccgtaacccgggaacgtcccgggggtcccccctaggaccgtattccgaggtcgcgnggcgggtctagggacagtacttcactctacaccatccaagccagccctgccgagggctaggaaagtagtgggggtaggtctaagtttacgtgacctgtccaagtactaaattattattactntacccttcgtacctttcggccccgttagggaccttaaagttgaatataacgaaacgattgtaagctaacg

SEQ ID NO: 348244 - DNA, 550 bp, Homo sapiens
  misc_feature: GZ8MTXP01D1U9P.45.37.D04.1.454.CMB.2.raw
  modified_base (364)..(364): a, c, t, g, unknown or other
  misc_feature (364)..(364): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacacctcaccggcgactatctccacgtgggtgcgacacggcccctggacaagggcttggagtggagtgggatggatcaaacccctaacaatggtggacaaacaaaactntgacaacagtaagtttcgagggcagggtcaccagtgaccgagggacacgtccagtcagcacacgcctacagtggagctgagcagactgacctatcgaagacgacaccggacctaagttttaattacgttgttcggaacggtaggtcgttcggtttaccgggttcggtcgtttcgggtttttcccgg

SEQ ID NO: 348245 - DNA, 517 bp, Homo sapiens
  misc_feature: GZ8MTXP01ETMEI.45.37.D04.1.454.CMB.2.raw
  modified_base (311)..(311): a, c, t, g, unknown or other
  misc_feature (311)..(311): n is a, c, g, or t
  modified_base (356)..(356): a, c, t, g, unknown or other
  misc_feature (356)..(356): n is a, c, g, or t
  modified_base (406)..(406): a, c, t, g, unknown or other
  misc_feature (406)..(406): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaaacaataagaactactagcttggtaccagcagaaaccaggtcagcctctaagctgctcatttacnggcatcctaccgggaatccggggtcccctggaccgattcagtgcnggcgggtctgggacagtattcactctcacatcagcagctgcagctgaagntggggtgtctagtttatgctgtcagctaatattattataactttccttccgtactttccggcccgtgggaacccaaagttcggaatactaacaaacgtacttgtcggctcg

SEQ ID NO: 348246 - DNA, 525 bp, Homo sapiens
  misc_feature: GZ8MTXP01CXME5.45.37.D04.1.454.CMB.2.raw
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggagcctggggcctcagtgaaggtctcctgcaaggcttctggctacaccctcaccggcgactatcctccactgggtgcgacaggccccctggacaagggcttggagtggatgggatggatcaaccccctaanagtggtgcaaacaaactntgacacagaagtttcgagggcagggtcaccatcgacagggacacgtccagtcagcacacgcctacatcggagctgagcagctgacatctaagacgacgacggcctaatttacttacgttgttgcggtagtaacgttggttaccggttggtcgttgggttttccg

SEQ ID NO: 348247 - DNA, 497 bp, Homo sapiens
  misc_feature: GZ8MTXP01C72EY.45.37.D04.1.454.CMB.2.raw
  modified_base (357)..(357): a, c, t, g, unknown or other
  misc_feature (357)..(357): n is a, c, g, or t
  modified_base (444)..(444): a, c, t, g, unknown or other
  misc_feature (444)..(444): n is a, c, g, or t
  modified_base (476)..(476): a, c, t, g, unknown or other
  misc_feature (476)..(476): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctggggcctcagtgaaggtctcctgcaaggcttctggctacacctcaccggcgactatctccactgggtgcgacaggcccctggacaagggcttgagtggatgggatggatcgaaccccctacaatggtgcaaacaaactntgcacagaagtttcagggcagggtcaccgatgaccagggacacgtccatcagcacagcctacatggagctgagcaagactgacatcngacacacggcatttattacgttgttgcgaggntgttacgttgtcttggtttcc

SEQ ID NO: 348248 - DNA, 521 bp, Homo sapiens
  misc_feature: GZ8MTXP01CQHF6.45.37.D04.1.454.CMB.2.raw
  modified_base (313)..(313): a, c, t, g, unknown or other
  misc_feature (313)..(313): n is a, c, g, or t
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
  modified_base (456)..(456): a, c, t, g, unknown or other
  misc_feature (456)..(456): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactactagcttggtaccagcaagaaaccaggtcagccctcctaagctgctcatttacngggcatcgtacccgggatcccggggtccccctgaccgnttcagtggcnggcgggtctgggacagtatttcactctcaccatcagcagcctgcaggctagaagtagtgggtggctagtttatgctgtcagctaaatattaattntaacttccttcgtacttcggaccctggaaccaagttgaatataacaacgacttgtaacgctaacg

SEQ ID NO: 348249 - DNA, 504 bp, Homo sapiens
  misc_feature: GZ8MTXP01D0V18.45.37.D04.1.454.CMB.2.raw
  modified_base (359)..(359): a, c, t, g, unknown or other
  misc_feature (359)..(359): n is a, c, g, or t
  modified_base (446)..(446): a, c, t, g, unknown or other
  misc_feature (446)..(446): n is a, c, g, or t
  modified_base (463)..(463): a, c, t, g, unknown or other
  misc_feature (463)..(463): n is a, c, g, or t
  modified_base (475)..(475): a, c, t, g, unknown or other
  misc_feature (475)..(475): n is a, c, g, or t
  modified_base (490)..(490): a, c, t, g, unknown or other
  misc_feature (490)..(490): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacacctcaccggcgactatctccactgggtgcgacaggcccctggacaagggcttgagtggatgggatggatcaaaccccctaacaaatggtgcaaacaaactntgcacagaagtttcagggcagggtcaccatgaccagggacacgtccatcagcacagcctaacatggagctgagcagtactgacatcngacgacacggccaattnttacgttgttgngagaatgttaccggngtcttgggttttcc

SEQ ID NO: 348250 - DNA, 595 bp, Homo sapiens
  misc_feature: GZ8MTXP01ACWJZ.45.37.D04.1.454.CMB.2.raw
  modified_base (385)..(385): a, c, t, g, unknown or other
  misc_feature (385)..(385): n is a, c, g, or t
  modified_base (488)..(488): a, c, t, g, unknown or other
  misc_feature (488)..(488): n is a, c, g, or t
  modified_base (505)..(505): a, c, t, g, unknown or other
  misc_feature (505)..(505): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaaggtctcctgcagctctggctacacctcaccggcgactatcctccacgtgggtcgcgacgacggccccctaggacgaagggtcttggaggttggagtgggatggactaccgaaaccccccctaagaagtgggtacggacaaaacgaaactntgacagacgtaagttcgagggtacgagggtacaaccgagacgaaccgagggaccaccggtaccacacgacgaccaactacggacctaacagtcggaacgtcgngacgactagactgaacncgtcgaacgacgaccacggttccttagtttacttcgttgttcggaacgtaggtaagttcgggttacggttcgtcgtttcggttttaaccg

SEQ ID NO: 348251 - DNA, 572 bp, Homo sapiens
  misc_feature: GZ8MTXP01A29JL.45.37.D04.1.454.CMB.2.raw
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (338)..(338): a, c, t, g, unknown or other
  misc_feature (338)..(338): n is a, c, g, or t
  modified_base (459)..(459): a, c, t, g, unknown or other
  misc_feature (459)..(459): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctctgcagctngctacncctcacgcgactatctccacgtggtgcgacacggcccctggacgagggtctggagtggatgggatggactaccaaccctaanagtggtaggaacaacgaactatacgacaacgagtaacggtttcgacgggacgagggtaccaacgagtacgaccgaagggaccacgtccatacacgcacgaggtaccctaacagtagggacncgtaggacgacgagacgtagactatcgagaccggaacgacggtacctaagtttacgttccgttgtcggacggaaggttacgtacgggtttaccgggtggttcgttttccgggg

SEQ ID NO: 348252 - DNA, 739 bp, Homo sapiens
  misc_feature: GZ8MTXP01DHM9E.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgagacgggccaccatcaactgacaagtccagccagtagttgtttagacagctacaaacaataaacgtaactactagtcttacggtaccaagacaacgaaaccgaggtacacgtccctacctaagctcgctactatttacgtcggactacgtaccgtacccgggtaacgtccccggggtaccccctacggacgtagtcgaggtcggcgaacgggtccgggtacgtacggggactacggtactttaccaacccttcctaccgaacccctaataccgaacggtacccaacgccccgttggacccgtaaggggccttaagggaaagtgttcgggggttaggtacctttaaagtttttaccggtcgtcgttacgtaacgtaacgtaacttaaatttaaatttaactttaactttaacccgtttaccccgtttaccccggtttacccggtttacccgggttacccgggttaaccgggttaaaccggttaaacggttaacgtaacgtaacgtaaaccgtaaacgtaacgttacgtcggttcgtaacg

SEQ ID NO: 348253 - DNA, 553 bp, Homo sapiens
  misc_feature: GZ8MTXP01C9XGJ.45.37.D04.1.454.CMB.2.raw
  modified_base (362)..(362): a, c, t, g, unknown or other
  misc_feature (362)..(362): n is a, c, g, or t
  modified_base (420)..(420): a, c, t, g, unknown or other
  misc_feature (420)..(420): n is a, c, g, or t
  modified_base (440)..(440): a, c, t, g, unknown or other
  misc_feature (440)..(440): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctaccaaacaataaagaactactagcttggtaccagcaagaaaccaggtcagcctacctaagctgctcatttactggcatcgtacccggaatccggggtcccctgacgtattcgagtcgcnggcgggtctagggacagtattcactctacaccatcagcagcctgcaggctagaaagtntggggtggtactagttttangtctgtacatactaataattattattaacttccttaccgtaccgttaccgtaccgtacggttaacgttaacgttagtaataactaacgtaacgtaacgttacgtcgttcgtcg

SEQ ID NO: 348254 - DNA, 674 bp, Homo sapiens
  misc_feature: GZ8MTXP01BMI8F.45.37.D04.1.454.CMB.2.raw
  modified_base (372)..(372): a, c, t, g, unknown or other
  misc_feature (372)..(372): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcaaggcttctggctacacctcaccggcgactatctccacgtgggtgcgacgacggcccctggacgaagggcttgagtggagtgggatggatccaaaccccctaacaagtggtggacaaacgaaactntgcacaagtaagtttcgagggacgacggggtacaaccgagtacggaaccgaaggggaaccaccggttacccagtacacgccaacgtacggaccctaacacgtagggacgaccgtggacgacgaagaccgttacggaacctacgttaccgtaacggaaacccggaaccggtaaccccgggttaccttaaacgtttttaacgtttaaacccgttggttaccgggtaacgggtaacgggttaacgttttacggggttttaacccggggttcgggttcccggtttttcggggtttttttccccggg

SEQ ID NO: 348255 - DNA, 516 bp, Homo sapiens
  misc_feature: GZ8MTXP01DZ0QF.45.37.D04.1.454.CMB.2.raw
  modified_base (357)..(357): a, c, t, g, unknown or other
  misc_feature (357)..(357): n is a, c, g, or t
  modified_base (409)..(409): a, c, t, g, unknown or other
  misc_feature (409)..(409): n is a, c, g, or t
  modified_base (423)..(423): a, c, t, g, unknown or other
  misc_feature (423)..(423): n is a, c, g, or t
  modified_base (451)..(451): a, c, t, g, unknown or other
  misc_feature (451)..(451): n is a, c, g, or t
  modified_base (476)..(476): a, c, t, g, unknown or other
  misc_feature (476)..(476): n is a, c, g, or t
  modified_base (484)..(484): a, c, t, g, unknown or other
  misc_feature (484)..(484): n is a, c, g, or t
  modified_base (498)..(498): a, c, t, g, unknown or other
  misc_feature (498)..(498): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacacctcaccggcgactatctccactgggtgcgacaggcccctggacaagggcttgagtggatggatggatcaaaccccctaacaatggtgcaaacaaactngcacagtaagttcgagggcagggtcaccatgacagggacacgtcatcagcanacgcctacatgganctgagcaagctgaacatctaagacgacncggacctatttaattacgttgttgngtagggtnttcggtttaccggnggtccgttggttttcccg

SEQ ID NO: 348256 - DNA, 534 bp, Homo sapiens
  misc_feature: GZ8MTXP01BMW8X.45.37.D04.1.454.CMB.2.raw
  modified_base (346)..(346): a, c, t, g, unknown or other
  misc_feature (346)..(346): n is a, c, g, or t
  modified_base (361)..(361): a, c, t, g, unknown or other
  misc_feature (361)..(361): n is a, c, g, or t
  modified_base (387)..(387): a, c, t, g, unknown or other
  misc_feature (387)..(387): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctaccaacaataagaactactagcttaggtaccagacagaaaccaggtcagcctacctaagctgctctatttactggcatacctaccgggaatccggggtccccngacgattcagtggcngcgggtcgtggacagtatttcactcncaccatcagcacgccctgccaggctaggaaagtgtgggtggctaagtttagtgctgtcagtctaaattattattatcttccttcgtctttcggcccgtaggaacccgttaagttaggaatataacaaacgacttgtaacgcgtaacg

SEQ ID NO: 348257 - DNA, 545 bp, Homo sapiens
  misc_feature: GZ8MTXP01B6X6D.45.37.D04.1.454.CMB.2.raw
  modified_base (456)..(456): a, c, t, g, unknown or other
  misc_feature (456)..(456): n is a, c, g, or t
  modified_base (458)..(458): a, c, t, g, unknown or other
  misc_feature (458)..(458): n is a, c, g, or t
  modified_base (524)..(524): a, c, t, g, unknown or other
  misc_feature (524)..(524): n is a, c, g, or t
tcagacgcgatcgacacgaccggtgctcgatttagtagcatactgttggggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctgggggctgaggtgaggaagcctgggggcctcagtgaaggtctcctgcaaggcttctggctacacccttcaccggcgactatcctccactggggtgcgacgacgggcccccctgggacaaaggggcttggagttggagttggggatggatacaaacccctaaacaatggtaggacaacaaaaaactatgacaacagtaagtttcgaaggggcagggtcaccatgaccgaggacacgtccatccagcacagcctagatggancngagcagactgacatctgaacgacacggccttatttatacttgttcgcgtaaggtgtgtttaccggnggttcctggtttcctttaagg

SEQ ID NO: 348258 - DNA, 563 bp, Homo sapiens
  misc_feature: GZ8MTXP01EAUMK.45.37.D04.1.454.CMB.2.raw
  modified_base (363)..(363): a, c, t, g, unknown or other
  misc_feature (363)..(363): n is a, c, g, or t
  modified_base (442)..(442): a, c, t, g, unknown or other
  misc_feature (442)..(442): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacacctcaccggcgactatctccactgggtgcgacacggcccctggacaagggcttgagtggagtgggatggataccgaaaccccctaacaagtggtagcaaacaaactntggacacgagtaagtttcgagggcagggtcacatcgacgagggacacgtcatcagcacacgacctacagtcggagccgngagacaggacctaggacctatcgtaagaccgacgaccgggcctaattttacgttacgttggttacggccggtaaggtaagtttcggtttaccgggttggttccgtttcgggtttttcccgg

SEQ ID NO: 348259 - DNA, 704 bp, Homo sapiens
  misc_feature: GZ8MTXP01EB1E1.45.37.D04.1.454.CMB.2.raw
  modified_base (252)..(252): a, c, t, g, unknown or other
  misc_feature (252)..(252): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaagccgtggggcctgagtgaaggtctctgcaggcttcnggctacacctcaccggcgactatctccacgtgggtcgcgacgacggcccctggaacaagggcttggaggtggagtgggatggataccaaaccccctaaacaaagtgggtacggacaaaacgaaactgtacggactaacgaaggtaacggtttacggaaggggtaccgaaggggttaccaaccgaagtacggaaacccgaaggggaaccaaccggttaccaactacgaacgacgaaaccgacggtacccttaaacgaaggttacgggaacgtccgtaggaacggacaaacggtaccgttaggaacctacgttaccgtaacggaaccggaaaccgtaccgggttacccttaaagttttaacgttaaccgttggttacggtaaccgggtaagggttaagttttaccgggtttaccggggttcgggtttaacccgtttcgggttttttaacccggg

SEQ ID NO: 348260 - DNA, 478 bp, Homo sapiens
  misc_feature: GZ8MTXP01BRXAY.45.37.D04.1.454.CMB.2.raw
  modified_base (338)..(338): a, c, t, g, unknown or other
  misc_feature (338)..(338): n is a, c, g, or t
  modified_base (350)..(350): a, c, t, g, unknown or other
  misc_feature (350)..(350): n is a, c, g, or t
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
  modified_base (427)..(430): a, c, t, g, unknown or other
  misc_feature (427)..(430): n is a, c, g, or t
  modified_base (433)..(434): a, c, t, g, unknown or other
  misc_feature (433)..(434): n is a, c, g, or t
  modified_base (436)..(436): a, c, t, g, unknown or other
  misc_feature (436)..(436): n is a, c, g, or t
  modified_base (453)..(453): a, c, t, g, unknown or other
  misc_feature (453)..(453): n is a, c, g, or t
  modified_base (457)..(457): a, c, t, g, unknown or other
  misc_feature (457)..(457): n is a, c, g, or t
  modified_base (459)..(459): a, c, t, g, unknown or other
  misc_feature (459)..(459): n is a, c, g, or t
  modified_base (461)..(461): a, c, t, g, unknown or other
  misc_feature (461)..(461): n is a, c, g, or t
  modified_base (463)..(463): a, c, t, g, unknown or other
  misc_feature (463)..(463): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatgggatggatcaacctanaatggtggacanaactatgcacagaagtttcaagggcagggtcacatgaccagggacacgtccatcagcacaggctacatgagcngngnnnnacnncngcgacacgctattattnttgngngngngtgttcgtgttcgtg

SEQ ID NO: 348261 - DNA, 499 bp, Homo sapiens
  misc_feature: GZ8MTXP01BXX8X.45.37.D04.1.454.CMB.2.raw
  modified_base (360)..(360): a, c, t, g, unknown or other
  misc_feature (360)..(360): n is a, c, g, or t
  modified_base (448)..(448): a, c, t, g, unknown or other
  misc_feature (448)..(448): n is a, c, g, or t
  modified_base (465)..(465): a, c, t, g, unknown or other
  misc_feature (465)..(465): n is a, c, g, or t
  modified_base (472)..(472): a, c, t, g, unknown or other
  misc_feature (472)..(472): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctctgcaaggcttctggctacaccttcaccggcgactatctccactgggtgcgacaggccgctggacaagggcttgagtggatggggatggactcaacctaacaatggtaggcaacgaaactangcacagaagtttcgagggcagggtcaccatgaccgagggacacgtcatcagcacgacgcctacatggagctgagcagactgacaatcngacgacgacgtcatttnttactgngtcgaggattcggttaaccggttgtcg

SEQ ID NO: 348262 - DNA, 520 bp, Homo sapiens
  misc_feature: GZ8MTXP01D29V1.45.37.D04.1.454.CMB.2.raw
  modified_base (312)..(312): a, c, t, g, unknown or other
  misc_feature (312)..(312): n is a, c, g, or t
  modified_base (363)..(363): a, c, t, g, unknown or other
  misc_feature (363)..(363): n is a, c, g, or t
  modified_base (420)..(420): a, c, t, g, unknown or other
  misc_feature (420)..(420): n is a, c, g, or t
  modified_base (499)..(499): a, c, t, g, unknown or other
  misc_feature (499)..(499): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactactagcttggtaccagcagaaaccaggtcagcctcctaagctgctctatttacngggcattcctacccgggaatcccggggtccccctgaccgattccagtggcnggcgggtctggggacagtatttcactctcaccatcagcagcctgcaggctgaaagtntgggtgctagtttatgctgtcagctaattattattataacttccttcgtacttcggccctgggaaccttagttgaatanaacaacgacttgtcgctaacg

SEQ ID NO: 348263 - DNA, 589 bp, Homo sapiens
  misc_feature: GZ8MTXP01AVAAG.45.37.D04.1.454.CMB.2.raw
tcagacgcgatcgacacgaccggtgctcgatttagtagcatactgttgggtttgggggagttacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctaccaacaataagaactacttagcttggtaccagcagaaaccaggtcagcctcctaagctgctctatttactgggctagtccgtacccgggaatcccgggggtccctcggaccgtattcgagtggacaggcgggtctgggacagtatttcactctacacatcagcagcctgctagggcttagaaagatggtgggactagtttatgtctgtcagactaattattattacttaacttccctccgttacgttttcccgggccccgttagggtaaccccttaaagggttcggttaacttaacgtaaccgtaaaacggtaaccgtgggttaccgggtccgttcggtaacccc

SEQ ID NO: 348264 - DNA, 651 bp, Homo sapiens
  misc_feature: GZ8MTXP01AQHAF.45.37.D04.1.454.CMB.2.raw
  modified_base (292)..(292): a, c, t, g, unknown or other
  misc_feature (292)..(292): n is a, c, g, or t
  modified_base (373)..(373): a, c, t, g, unknown or other
  misc_feature (373)..(373): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaaggtctcctgcaggctctggctacacctcgaccggcgactatctccacgtggtgcgacncggcccctggacaagggcttgagtggagtgggatggataccgaaaccccctaacgaaagtgggtacggacaaaacaaactntgacaacaaggtaagtttcgagggtacgacgggtaccaaccgagtcgaaccgaggggaccaccgtaccatcgacgacctaacgaccgacctaacgagtagggacgtacgtaggaacggacgaaacggtacctaggaacctaacgtccgtaacggaaccggaacccgtaccgggttaccttaaagttttaaccttacggttggttacgggtcggtaagggttaacgtttcgggttttacccggggttgggttccggttttcgggttttttaaccccggg

SEQ ID NO: 348265 - DNA, 523 bp, Homo sapiens
  misc_feature: GZ8MTXP01AX2AF.45.37.D04.1.454.CMB.2.raw
  modified_base (456)..(456): a, c, t, g, unknown or other
  misc_feature (456)..(456): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacacctcaccggcgactatctccactgggtgcgacaggcccctggacaagggcttgagtggatgggatgggatcgaaaccccctaacaatggtggcaaacaaactaatgcaacagaagtttcaggggcagggtcaccgatgaccaggggacacggtccatcagcacagccgtacagtcggagctgagcaggactgacatcngacgacacggcctatttacttagttgttgcgaggaattggttaccggttggtcgttcgggttttccg

SEQ ID NO: 348266 - DNA, 565 bp, Homo sapiens
  misc_feature: GZ8MTXP01BDFLM.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctgggggcctcagtgaaggtctcctgcaggcttctggctacacctcaccggcgactatctccactgggtgcgacaggcccctggacaagggcttgagtggagtgggatggatcaaccccctaacaatggtggcaaacgaaactaatgcacagaagtttcgagggcagggtcaccatgaccagggacacgtccatcagcacacgccgtacacgtgggaagctggacgcgacggactggacagttccgtaaggaacgaccgacgggccctaattttaacgttaccgttggttcggtccggtaggtaacgtttcggtttacccggggttggtccgtttgggtttttccccg

SEQ ID NO: 348267 - DNA, 589 bp, Homo sapiens
  misc_feature: GZ8MTXP01ARBG7.45.37.D04.1.454.CMB.2.raw
  modified_base (313)..(313): a, c, t, g, unknown or other
  misc_feature (313)..(313): n is a, c, g, or t
  modified_base (347)..(347): a, c, t, g, unknown or other
  misc_feature (347)..(347): n is a, c, g, or t
  modified_base (366)..(366): a, c, t, g, unknown or other
  misc_feature (366)..(366): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggtcaccatcaactgcaagtccagccagagtgtttagacagctaccaacaataagaactactagctgtaccagcaagaaaccagtcagccctactaagctgctctatttacnggcatccgtacccgggaagtcccggggtcccccnggaccgtattcaggtgcgnggcgggtcgtgggacagtattcactctacaccatcagcacgcctgcaggctaggaaagtgtggggtggtacttaggtttactggccttggactaagtactaaatttattaatttaacttaacttcccttccgttaaccgttttccgggaccccgtttaaggggaacccttaaaggttcggtaaacttacgtaaccgaaaacggtacttgggttcggcctaacg

SEQ ID NO: 348268 - DNA, 508 bp, Homo sapiens
  misc_feature: GZ8MTXP01EKRRM.45.37.D04.1.454.CMB.2.raw
  modified_base (425)..(425): a, c, t, g, unknown or other
  misc_feature (425)..(425): n is a, c, g, or t
  modified_base (427)..(427): a, c, t, g, unknown or other
  misc_feature (427)..(427): n is a, c, g, or t
  modified_base (438)..(438): a, c, t, g, unknown or other
  misc_feature (438)..(438): n is a, c, g, or t
  modified_base (441)..(441): a, c, t, g, unknown or other
  misc_feature (441)..(441): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacacctcaccggcgactatctccactgggtgcgacaggcccctggacaagggcttgagtggatgggatggatcaaccccctaacaatggtggcaaacaaactaatgacaacagaagtttcagggcagggtcacatgacaggacacgtcatcagcacagctacatggagcngngcagactgacntcngacgacacggcctatttattacgttgttcgcgaggtgttggttaccggttggtcgttggttttcccg

SEQ ID NO: 348269 - DNA, 541 bp, Homo sapiens
  misc_feature: GZ8MTXP01B8HUZ.45.37.D04.1.454.CMB.2.raw
  modified_base (322)..(322): a, c, t, g, unknown or other
  misc_feature (322)..(322): n is a, c, g, or t
  modified_base (434)..(434): a, c, t, g, unknown or other
  misc_feature (434)..(434): n is a, c, g, or t
  modified_base (521)..(521): a, c, t, g, unknown or other
  misc_feature (521)..(521): n is a, c, g, or t
tcagacgcgatcgacacgaccggtgctcgatttagtagcatactgttgggtttgggggagctacaacaggcaggcaggggcagcaagatggtgttgcagacccaggtcttaatttctctgttgctctggatctctggtgcctacggggacatcgtgatgacccagtctccagactccctggctgtgtctctgggcgagagggccaccatcaactgcaagtccagccagagttgtttagacagcctaccaaacaataaagaactacttagcttggtaccagacaagaaaccaggtacagcctacctaagctgctcatttacgngggcatccgtaacccgggaagtccccggggtcctcggaccgtattcgaggtcggacagggcgggtctgggacagtactttcactctcacatcagcagcctgcaggctagaanagtgtgggcttaggtttatgctgtcagtactaatattatattacttcccgtcgttactttcgcccgtagggaaccaaggttgataanacaaagtactgttgcttgcc

SEQ ID NO: 348270 - DNA, 567 bp, Homo sapiens
  misc_feature: GZ8MTXP01C6MHX.45.37.D04.1.454.CMB.2.raw
  modified_base (229)..(229): a, c, t, g, unknown or other
  misc_feature (229)..(229): n is a, c, g, or t
  modified_base (364)..(364): a, c, t, g, unknown or other
  misc_feature (364)..(364): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtatgggggctggaggtgaggaagccgtggggcctnagtgaaggtctcctgcaaggcttctggctacacctcaccggcgactatctccacgtgggtgcgacacggcccctggacaagggcttgagtggatgggatggatcaaaccccctaacatggtggacaaacaaactntcgcaacagaagtttcaggggcagggtcacatgaccagggacacgtcatcagcacagcctacatggagctgagcagactagacatcgtcgaacgacgaccgggccctaattttacgtttaaccgttggttacggaaccgggtaagggtaacgtttacggggtttacccggggttcgggttccgttcggggttttttaacccgg

SEQ ID NO: 348271 - DNA, 576 bp, Homo sapiens
  misc_feature: GZ8MTXP01DORQD.45.37.D04.1.454.CMB.2.raw
  modified_base (294)..(294): a, c, t, g, unknown or other
  misc_feature (294)..(294): n is a, c, g, or t
  modified_base (487)..(487): a, c, t, g, unknown or other
  misc_feature (487)..(487): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaacgcccgggctcgagtgaaggtctcctgcaaggctcgtggctacaccttcaccggcactactctccacgtgggtgcgacncggcccctggacaaggcttggagtggatgggatggactaccgaaacctaacgaagtgggtacggacaacgaaaaactatcgacaacaggtaaacgtttcgaaggggcacgggtacaccgagtacgaaccgaagggaccaacggtccatcgagcaacacgcctaacgagtggagcagacgcaggactgacatcncgaacgacacggtaccttaatttacgttacgttgttgacgtaaggtacgttcggtttaccggtggttcgtttcggtttccgtttaacgg

SEQ ID NO: 348272 - DNA, 537 bp, Homo sapiens
  misc_feature: GZ8MTXP01DJA3P.45.37.D04.1.454.CMB.2.raw
  modified_base (495)..(495): a, c, t, g, unknown or other
  misc_feature (495)..(495): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagccccactcccaggtgcagctggtgcagtctggggctgaggtgaggaagcctggggcctcagtgaggtctcctgcaaggcttctggctacaccttcaccggcgactatctccactggggtgcgacacgggccccctgggacaaggggcttggagtggatgggggatggatcaaacccctaacaagtggtggcacaaaactatgcacagaagtttcagggcgagggtcaccatgaccagggacacgtccatcagcacagccctacgactgggtaagcgtagagcagactgacatctgaacgtacacggccttagtttatacttgttgacgnggtagtgtttacgggtggttcgttggtttccgttttaacggg

SEQ ID NO: 348273 - DNA, 512 bp, Homo sapiens
  misc_feature: GZ8MTXP01ESC24.45.37.D04.1.454.CMB.2.raw
  modified_base (362)..(362): a, c, t, g, unknown or other
  misc_feature (362)..(362): n is a, c, g, or t
  modified_base (450)..(450): a, c, t, g, unknown or other
  misc_feature (450)..(450): n is a, c, g, or t
  modified_base (485)..(485): a, c, t, g, unknown or other
  misc_feature (485)..(485): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctgaggtgaggaagcctgggggcctcagtgaaggtctcctgcaaggcttctggctacacctcaccggcgactatctccactgggtgcgacacggccccctggacaagggcttgagtggatgggatggatcaaaccccctaacaatggtggcaaacaaactntgacacagaagtttcgagggcagggtcaccatgaccagggacacgtcatcagcacagcctacagtggagctgagcagacctgacatcngacgacacggcctatttattacgttgttgcgagtnttggttaccggttgtcgttggtttccg

SEQ ID NO: 348274 - DNA, 519 bp, Homo sapiens
  misc_feature: GZ8MTXP01DFSHN.45.37.D04.1.454.CMB.2.raw
  modified_base (313)..(313): a, c, t, g, unknown or other
  misc_feature (313)..(313): n is a, c, g, or t
  modified_base (359)..(359): a, c, t, g, unknown or other
  misc_feature (359)..(359): n is a, c, g, or t
  modified_base (503)..(503): a, c, t, g, unknown or other
  misc_feature (503)..(503): n is a, c, g, or t
  modified_base (510)..(510): a, c, t, g, unknown or other
  misc_feature (510)..(510): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaaacaataagaactactagcttggtaccagcagaaaccaggtcagcctactaagctgctctatttacnggcatcgtacccgggatcccggggtcccctgaccgattcagtcgcnggcgggtctgggacagtactttcactctcaccatcagcagcctagcaggctagaaagtgtgggtggtcttaagtttatggcttgtcagtctaattattattataacttccttcgtactttcggcctgggaccaaggttgaatancaaacgnttgtgctcg

SEQ ID NO: 348275 - DNA, 546 bp, Homo sapiens
  misc_feature: GZ8MTXP01DOFS4.45.37.D04.1.454.CMB.2.raw
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
  modified_base (368)..(368): a, c, t, g, unknown or other
  misc_feature (368)..(368): n is a, c, g, or t
  modified_base (462)..(462): a, c, t, g, unknown or other
  misc_feature (462)..(462): n is a, c, g, or t
  modified_base (465)..(465): a, c, t, g, unknown or other
  misc_feature (465)..(465): n is a, c, g, or t
  modified_base (501)..(501): a, c, t, g, unknown or other
  misc_feature (501)..(501): n is a, c, g, or t
  modified_base (519)..(519): a, c, t, g, unknown or other
  misc_feature (519)..(519): n is a, c, g, or t
  modified_base (531)..(531): a, c, t, g, unknown or other
  misc_feature (531)..(531): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagcctggggcctnagtgaaggtctctgcaaggcttcnggctacacctcaccggcgactatctccacgtgggtgcgacacggcccctggacaagggcttgagtggagtgggatggatcgaaaccccctaacaagtggtaggacaaaacaaacttgngaccaacgaagtaagtttccgaggggcaggggtacaaccgagtcgaaccgaaggggaccacgtaccagtcagcaactacgcctacagtggagcngancgaagtctgacatcaagacgacgacggctaagtttnttacgttgttcgcgagtnttcggttacggngtcgttggttttccg

SEQ ID NO: 348276 - DNA, 544 bp, Homo sapiens
  misc_feature: GZ8MTXP01DE149.45.37.D04.1.454.CMB.2.raw
  modified_base (442)..(442): a, c, t, g, unknown or other
  misc_feature (442)..(442): n is a, c, g, or t
tcagacgcgatcgacacgaccggtgctcgatttagtagcatactgttggggtttgggggcatcaccccagcaaccacatctgtcctctagagaatccccctgagagctccgttcctcaccatggactggacctggaggatcctcttcttggtggcagcagccacaagagccccactccccaggtgcagctggtgcagtctgggggctgaggtgaggaagcctgggggcctcagtgaaggtctcctgcaaggcttctggctacaccttcaccggcgactatctccactgggtgcgacaggccccctggacaaggggcttgagtggatggggatggatcaaaccctaacaatggtggcaacaaaaactatgacaacgaagtaagtttcaaggggcagggtcaccatcgaccagggacacgtccatcagcacagcctacatgganctgagcagactgacatctgaacgacacggccttaagtttattaacttgttgacgaaggtagttcggtttaccggtggttcgttcgggtttccttttaacggg

SEQ ID NO: 348277 - DNA, 566 bp, Homo sapiens
  misc_feature: GZ8MTXP01BOL27.45.37.D04.1.454.CMB.2.raw
  modified_base (320)..(320): a, c, t, g, unknown or other
  misc_feature (320)..(320): n is a, c, g, or t
  modified_base (374)..(374): a, c, t, g, unknown or other
  misc_feature (374)..(374): n is a, c, g, or t
  modified_base (398)..(398): a, c, t, g, unknown or other
  misc_feature (398)..(398): n is a, c, g, or t
  modified_base (412)..(412): a, c, t, g, unknown or other
  misc_feature (412)..(412): n is a, c, g, or t
  modified_base (478)..(478): a, c, t, g, unknown or other
  misc_feature (478)..(478): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttagacagctaccaaacaataaagaactactagcttggtaccagcaagaaaccaggtcacgcctacctaagctgctctatttacgngggcattccgtaacccgggaagtcccggggtcccctgaccgtatcgagtcggcnggcgggtctgggacagtacttacnctctcacctatcancacgcctggccgtagctagaaagtgtgggtgtctagtttactgctgtacagtataattattaattnttaacttcccttccgtaactttccggaccccgttagggaacccgttaaaggttcgtaatataacgaaacgtacgttagtcggctaacg

SEQ ID NO: 348278 - DNA, 511 bp, Homo sapiens
  misc_feature: GZ8MTXP01D4B5T.45.37.D04.1.454.CMB.2.raw
  modified_base (314)..(314): a, c, t, g, unknown or other
  misc_feature (314)..(314): n is a, c, g, or t
  modified_base (343)..(343): a, c, t, g, unknown or other
  misc_feature (343)..(343): n is a, c, g, or t
  modified_base (356)..(356): a, c, t, g, unknown or other
  misc_feature (356)..(356): n is a, c, g, or t
  modified_base (457)..(457): a, c, t, g, unknown or other
  misc_feature (457)..(457): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctaccaaacaataagaactactagcttggtaccagcaagaaaccaggtcagcctcctaagctgctcatttacnggcatctacccgggaatccggggtccccngacgatcagtgcnggcgggtctgggacagtattcactctcaccatcagcagcctgcaggctagaagatgggtggtctagtttatgctgtcagctaaattattatataacttccncgtactttcggcctggaaccaagttcggaatataacaaacgacttgtgctaacg

SEQ ID NO: 348279 - DNA, 544 bp, Homo sapiens
  misc_feature: GZ8MTXP01BW6NY.45.37.D04.1.454.CMB.2.raw
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagccccactccccaggtgcagctggtgcagtctgggggctgaggtgaggaagcctggggcctcagtgaaggtctcctgcaaggcttctggctacaccttcaccggcgactatctccactggggtgcgacacggccccctggacaaggggcttggagtggatgggatggatcaacctaacagtggtgcacaaaactatgacacagagttcgagggtcagggtcacatcgacagggacacgtcatcagcacacgcctacgagtggacgctgacgcagacctgactagtcgtgaacgaacgacggtccttaagtttactacgttgttgcggtaaggtagttcggtttaccgggtggttcgtttcgggtttccgttttaacggg

SEQ ID NO: 348280 - DNA, 522 bp, Homo sapiens
  misc_feature: GZ8MTXP01AWQCY.45.37.D04.1.454.CMB.2.raw
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (459)..(459): a, c, t, g, unknown or other
  misc_feature (459)..(459): n is a, c, g, or t
  modified_base (494)..(494): a, c, t, g, unknown or other
  misc_feature (494)..(494): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctgaggtgaggaagccgtggggcctcagtgaaggtctcctgcaaggcttctggctacacctcaccggcgactatctccactgggtgcgacaggccccctggacaagggcttgagtggatgggatggatcaaaccccctaacaagtggtggacaaaacgaaactaatgcaacagtaagtttacgagggcaggggtcaccatcgaccagggacacgtccatcagcacagcctacatgganccngagcagactgacatcngacgacacggcctattattacgttgttgcgaggtnttggttaccggttgtcgttggttttccg

SEQ ID NO: 348281 - DNA, 535 bp, Homo sapiens
  misc_feature: GZ8MTXP01DKN6S.45.37.D04.1.454.CMB.2.raw
  modified_base (441)..(441): a, c, t, g, unknown or other
  misc_feature (441)..(441): n is a, c, g, or t
tcagacgcgatcgacacgaccggtgctcgatttagtagcatactgttggggtttgggggcatcacccagcaaccacatctgtcctctagagaatcccctgagagctccgttcctcaccatggactggacctggaggatcctcttcttggtggcagcagccacaagagccccactcccaggtgcagctggtgcagtctgggggctgaggtgaggaagcctgggggcctcagtgaaggtctcctgcaaggcttctggctacaccttcaccggcgactatctccactgggtgcgacacggccccctggacaagggcttgagtggatggggatggatcgaacccctaacaagtggtggacaacgaaaactatgacaacagtaagtttcagggcagggtcaccatcgacgagggacacgtccatcagacacagcctacgatgggancgtgagcagactgacatctgaacgacacggccttagtttatcgttgttgcgaaggattcggttaccggtggttcgttcggtttccgttttaagg

SEQ ID NO: 348282 - DNA, 577 bp, Homo sapiens
  misc_feature: GZ8MTXP01EO7F8.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctaccaaacaataagaactactagcttggtaccagacagaaaccaggtcagccctacctaagctgctctatttacgtgggcagttaccgtacccggggaaacgtcccgggggtccccctcggaaccgtagtttcaggttcgggccaagggccgggtcgtaggggactagtactttcacttctcaccatcaagcaacgtcctgcgaggctagaaatgtggtggtctagtttactggactggtcagactaaattattattactaacttccttccgtacgtttccggccgtagggaaccttaagttgggaatagtaacgaaacgattaggtcgcgtaac

SEQ ID NO: 348283 - DNA, 509 bp, Homo sapiens
  misc_feature: GZ8MTXP01EYWT4.45.37.D04.1.454.CMB.2.raw
  modified_base (359)..(359): a, c, t, g, unknown or other
  misc_feature (359)..(359): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctgggggcctcagtgaaggtctcctgcaaggcttctggctacacctcaccggcgactatctccactgggtgcgacaggcccctggacaagggcttgagtggatgggatggatcaaccccctaacatggtggacaaacaaactntgacacagaagtttcagggcagggtcaccatgaccagggacacgtcatcagcacagcctacagtggagctgagcagactgacatctgacacgacggcctatttattacttgttgcgaggtaatggttaccggttggtcgttggttttccg

SEQ ID NO: 348284 - DNA, 587 bp, Homo sapiens
  misc_feature: GZ8MTXP01AHXCV.45.37.D04.1.454.CMB.2.raw
  modified_base (323)..(323): a, c, t, g, unknown or other
  misc_feature (323)..(323): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatcaactgacaagtccagccagtagttgtttagacagctaccaaacaataagaactactagctcggtaccagacaacgaaaccagtcacgcctaccaagctgctctatttacgnggacactccgtacccgggacgtccccggggtcccctacggaccgtattcgagtcggcgcggcgggtcgtgggactaggtacttccacttcctacacctatcacgccagcccagccgaggctaaggaatggttggggtacgtacttagtttagtcggctgtacagtactaattatttattactccttcccgttcggttacgttccggaccgtagggaaccttaggttacgaattacgaaccgtaacgacgttggtaacgctaacg

SEQ ID NO: 348285 - DNA, 564 bp, Homo sapiens
  misc_feature: GZ8MTXP01AGEVM.45.37.D04.1.454.CMB.2.raw
  modified_base (372)..(372): a, c, t, g, unknown or other
  misc_feature (372)..(372): n is a, c, g, or t
  modified_base (424)..(424): a, c, t, g, unknown or other
  misc_feature (424)..(424): n is a, c, g, or t
  modified_base (450)..(450): a, c, t, g, unknown or other
  misc_feature (450)..(450): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagacgcccactcccaggtgcagctggtgcagtcgtggggctggaggtgaggagccgtggggcctcgagtgaaggtctcctgcaggcttctggctacacctcgaccggcgactatctccacgtgggtgcgacgacggccccgtggacgaagggtcttggagtggagtgggatggatccaaacccctacgagtggtgacaaacaaactntgacagagtaagttcgagggcacggtcacagtacgacgagggacacgtcacncacgcacagacctacgagtggagtcngagcagacctgaacacttcgaagaaccgacaccggaccttaagtttacgttacgttggttagtcggtaggtaacgtttcgggttaccgggttgttccgttttcggttttcccgg

SEQ ID NO: 348286 - DNA, 574 bp, Homo sapiens
  misc_feature: GZ8MTXP01ECP4J.45.37.D04.1.454.CMB.2.raw
  modified_base (227)..(227): a, c, t, g, unknown or other
  misc_feature (227)..(227): n is a, c, g, or t
  modified_base (249)..(249): a, c, t, g, unknown or other
  misc_feature (249)..(249): n is a, c, g, or t
  modified_base (353)..(353): a, c, t, g, unknown or other
  misc_feature (353)..(353): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggagatcctcttcttggtggcagcagccaacaagacgcccactcccaggtgcagctggtgcagtcgtgggctgaggtgaggagcgtgggcctnagtgagtctctgcaggcttcgnggctacaccttcgaccggcgaactatcctccacgttgggcgccgacgacggcccctaggaacaagggtcttggagtggatgggatggactaccgaaaccctaanaagtggtacgaacaacaactatgacaacaagtaacgttcgagggcgaggtacacagacgacgaggacacgtaccanacanacacgacgtactagagtagagcgagacgactacgactacgactagtaacgaacgaacgacgaaccgtactttaagtttacgttcgttggtaaggtacggtaaggttacgttacgggtttaccgggtcggtttccgtttcgg

SEQ ID NO: 348287 - DNA, 691 bp, Homo sapiens
  misc_feature: GZ8MTXP01DT4KG.45.37.D04.1.454.CMB.2.raw
tcagacgcgatcgacacgaccggtgctcgattttagtagcatactgttgggtttgggggcatcacccagcaaccacatctgtcctctagagaatcccctgagagctccgttcctcaccatggactggacctggaggatcctcttcttggtggcagcagccacaagagcccactccccaggtgcagctggtgcagtcgtggggctgaggtgaggaagcctggggcctcagtgaaggtctcctgcaaggcttctggctacaccttcgaccggcgactatcctccacgtgggtgcgacacgggccccctgggacaagggtcttagaggtggagtgggatggactaccaaaccctaagaagtggtacggaccaaacgaaaaaactagtcgacaaacgtaagtaaacgtttcgaacggggcgtaacgggtccaaacgatacggaaccgaagggaaccgaaccgttaccaataccgaacgaccaacgtaacgaccctaaggaacgtgggacgcgtagaacggacaacggaaccctaggaaactacgttaccgtaacggaaacccgaaacgttaacccgggtaccctttaaaggttttaaacttaccgttagggttcggaccgggtaagggttacgtttaacgggttttaccggggtcggtttaccgtttccgggtttttaacccgtttttaacgggg

SEQ ID NO: 348288 - DNA, 512 bp, Homo sapiens
  misc_feature: GZ8MTXP01C4WGI.45.37.D04.1.454.CMB.2.raw
  modified_base (362)..(362): a, c, t, g, unknown or other
  misc_feature (362)..(362): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
  modified_base (494)..(494): a, c, t, g, unknown or other
  misc_feature (494)..(494): n is a, c, g, or t
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagccccactccccaggtgcagctggtgcagtctgggggctgaggtgaggagcctgggggcctcagtgaaggtctcctgcaaggcttctggctacaccttcaccggcgactatctccactgggtgcgacaggccccctggacaaggggcttgagtggatggggatggatcaaccctaacaatggtggcacaaaactntgcacagaagttcagggcagggtcacatgaccgagggacacggtccatcagcacagcctanagtggancgtgagcagactgacatctgaacacacggcagtttatacttgttgcgaagtagtgtttaccggnggttctggtttcgtttcg

SEQ ID NO: 348289 - DNA, 590 bp, Homo sapiens
  misc_feature: GZ8MTXP01CAFEJ.45.37.D04.1.454.CMB.2.raw
  modified_base (484)..(484): a, c, t, g, unknown or other
  misc_feature (484)..(484): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccctcaccggcgactatcctccacgtgggtgcgacgacggcccccgtaggaccgaaggggtcttaggaggtggagtgggggatgggactaccaaacccccctaacaagtgggtcggacaaacgaaactgtcgacacagtaagtttcgagggcgagggtcaccagtcgaccgagggacacgtcactcacgcacacgcctacagtggaacgctgagcaaggctgactntcgtaagaaccgacaccggttccgttaattttacgttaacgttggttacgcggtaaggtcgtttcgggtttaccgggttcggtccgtttcgggttttttaacccgg

SEQ ID NO: 348290 - DNA, 566 bp, Homo sapiens
  misc_feature: GZ8MTXP01EI173.45.37.D04.1.454.CMB.2.raw
  modified_base (342)..(342): a, c, t, g, unknown or other
  misc_feature (342)..(342): n is a, c, g, or t
  modified_base (362)..(362): a, c, t, g, unknown or other
  misc_feature (362)..(362): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttctggctacacctcaccggcgactatctccacgtgggtgcgacacggcccctggacaagggcttgagtggatggatggatcaaccccctaanaatggtggacaaacaaactntgacaaccgagtaacgtttcgaggggtcgaggggttacaccagtacgaccgaggggaaccacggtaccactcacgcaacacgacctacagtggacgtccagacgccaagacctggacattcgaagacgacgacggcctaatttaacttacgttgttcgaacgtagtaacgtttcggttaccggttcggtcgtttcggttttccg

SEQ ID NO: 348291 - DNA, 592 bp, Homo sapiens
  misc_feature: GZ8MTXP01EBGIF.45.37.D04.1.454.CMB.2.raw
  modified_base (343)..(343): a, c, t, g, unknown or other
  misc_feature (343)..(343): n is a, c, g, or t
  modified_base (363)..(363): a, c, t, g, unknown or other
  misc_feature (363)..(363): n is a, c, g, or t
  modified_base (446)..(446): a, c, t, g, unknown or other
  misc_feature (446)..(446): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggagccgtggggcctcagtgaaggtctcctgcaaggcttctggctacacctcaccggcgactatctccacgtgggtgcgacacggccccctggacaagggcttggagtggatgggatggatcaaccccctanaagtggtgacaaacaaactntgacacaagtaagtttcgagggcagggtcaccagtcgaccgagggtacacgtacatcagcacacgacctacagtggaacgtcngacgcaacgactagaactacgtcgtaagaccgaacgtaccgggttaccttaaattttacgttaaccgttggttacggtaacgggtaggttaacgtttacgggtttaccgggttcgggttaaccgttttcggggttttttaacccgg

SEQ ID NO: 348292 - DNA, 513 bp, Homo sapiens
  misc_feature: GZ8MTXP01B20ZY.45.37.D04.1.454.CMB.2.raw
  modified_base (225)..(225): a, c, t, g, unknown or other
  misc_feature (225)..(225): n is a, c, g, or t
  modified_base (241)..(241): a, c, t, g, unknown or other
  misc_feature (241)..(241): n is a, c, g, or t
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
  modified_base (277)..(277): a, c, t, g, unknown or other
  misc_feature (277)..(277): n is a, c, g, or t
  modified_base (352)..(352): a, c, t, g, unknown or other
  misc_feature (352)..(352): n is a, c, g, or t
  modified_base (424)..(424): a, c, t, g, unknown or other
  misc_feature (424)..(424): n is a, c, g, or t
  modified_base (482)..(482): a, c, t, g, unknown or other
  misc_feature (482)..(482): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctnagtgagtctctgcagntcnggctacnctcacggcgactatctccactgggtncgacaggcccctggacaagggcttgagtggatgggatggatcgaaaccccctaacaatggtggacaaacaaactntgacacagtaagtttcgagggcagggtcaccatcgaccagggacacgtccatcagcacacgcctacatgganctgagcagactgacatcaagacgacacggcctaatttattacgttgttgaacgaggtnttggttaccggttggtcgttgggttttcccg

SEQ ID NO: 348293 - DNA, 531 bp, Homo sapiens
  misc_feature: GZ8MTXP01DPBPC.45.37.D04.1.454.CMB.2.raw
  modified_base (443)..(443): a, c, t, g, unknown or other
  misc_feature (443)..(443): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccagtgggtgcgacacggcccctaggacaagggtcttgagtggagtgggatggactacccaaaccctaagaagtggtagaacaacaactatcgacacagtaagttcgagggcaggtcacatcgacgaggacacgtcatcagcaacacggcctaacgagtcggancgtagagacagactgacatcacgacgacgacgtactatttacgttcgttgtcgagtaaggtattcgggttacggtgttcgttttcggg

SEQ ID NO: 348294 - DNA, 528 bp, Homo sapiens
  misc_feature: GZ8MTXP01ADNM8.45.37.D04.1.454.CMB.2.raw
  modified_base (313)..(313): a, c, t, g, unknown or other
  misc_feature (313)..(313): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctaccaacaaataagaactactagcttggtaccagcagaaaccaggtcagcctccaagctgctcatttacnggcatctacccgggaatcccggggtcccctggaccgattcagtggcnggcgggtntgggacagtactttcactctcaccatcagcagcctgcaggctagaagatggggtggctagtttatgtctgtcagtctaattattattattaacttccttcgtactttcggccctgggaccttaaggttggtaatataacgaaacgacgttgtggctaacg

SEQ ID NO: 348295 - DNA, 511 bp, Homo sapiens
  misc_feature: GZ8MTXP01ADIJY.45.37.D04.1.454.CMB.2.raw
  modified_base (359)..(359): a, c, t, g, unknown or other
  misc_feature (359)..(359): n is a, c, g, or t
  modified_base (495)..(495): a, c, t, g, unknown or other
  misc_feature (495)..(495): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctgggggcctcagtgaaggtctcctgcaaggcttctggctacacctcaccggcgactatctccactgggtgcgacaggcccctggacaagggcttgagtggatgggatggatcaaccccctaacaatggtggcaacaaactntgcacagaagtttcagggtcagggtcaccatgaccagggacacgtccgatcagcacacgcctacatggacgctgagcagactgacatctgacgacaccggctaactttattacgttgttgcgagtgtggttacggngtcgttggttttcccg

SEQ ID NO: 348296 - DNA, 534 bp, Homo sapiens
  misc_feature: GZ8MTXP01DTCTL.45.37.D04.1.454.CMB.2.raw
  modified_base (354)..(354): a, c, t, g, unknown or other
  misc_feature (354)..(354): n is a, c, g, or t
  modified_base (449)..(449): a, c, t, g, unknown or other
  misc_feature (449)..(449): n is a, c, g, or t
  modified_base (469)..(469): a, c, t, g, unknown or other
  misc_feature (469)..(469): n is a, c, g, or t
  modified_base (475)..(475): a, c, t, g, unknown or other
  misc_feature (475)..(475): n is a, c, g, or t
  modified_base (492)..(492): a, c, t, g, unknown or other
  misc_feature (492)..(492): n is a, c, g, or t
  modified_base (513)..(513): a, c, t, g, unknown or other
  misc_feature (513)..(513): n is a, c, g, or t
tcagacgcgatcgacacgaccggtgctcgatttagtagcatactgttggggtttgggggcatcacccagcaaaccacatctgtcctctagagaatccccctgagagctccgttcctcaccatggactggacctggaggatcctcttcttggtggcagcagccacaagagccccactccccaggtgcagctggtgcagtctggggctgaggtgaggaagcctggggcctcagtgaaggtctcctgcaaggcttctggctacaccttcaccggcgactatctccactgggtgcgacacggccccctggacaagggcttggagtggatggggatggatcgaaaccctaacagttggnggacaacaaaaactatgacaacagtaagtttcgaggggacagggtcaccgatcgaacagggacacgtcatcagcacacgcctaacgacgtgggancgtgagcagactgaccatcngaacanacggcttagtttatacngttgcgaagattcgttacggngttcgttgtttcgtttaacgg

SEQ ID NO: 348297 - DNA, 546 bp, Homo sapiens
  misc_feature: GZ8MTXP01D8MOP.45.37.D04.1.454.CMB.2.raw
  modified_base (226)..(226): a, c, t, g, unknown or other
  misc_feature (226)..(226): n is a, c, g, or t
  modified_base (399)..(399): a, c, t, g, unknown or other
  misc_feature (399)..(399): n is a, c, g, or t
  modified_base (424)..(424): a, c, t, g, unknown or other
  misc_feature (424)..(424): n is a, c, g, or t
  modified_base (439)..(439): a, c, t, g, unknown or other
  misc_feature (439)..(439): n is a, c, g, or t
  modified_base (453)..(453): a, c, t, g, unknown or other
  misc_feature (453)..(453): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagaacccactcccaggtgcagctggtgcagtctggggctgaggtgaggaagcctggggcctnagtgaaggtctcctgcaaggcttctggctacaccttcaccggcgactatctccactgggtgcgacaggcccctggacaagggcttggagtggatggggatggatcgaaaccctaaccaaatggtgacaacaaaaaactatgcaacagaaagtttcgagggcagggtcaccgangaccgaaggacacgtccatcagcanagcctagatgggacncgagagacgagacngtactatcgacgaacgacgacgtacttagtttacttagttggttcgacggtaaggtagttcggtttcggtggttccgtttcggttttcgtttg

SEQ ID NO: 348298 - DNA, 531 bp, Homo sapiens
  misc_feature: GZ8MTXP01BWQZX.45.37.D04.1.454.CMB.2.raw
  modified_base (226)..(226): a, c, t, g, unknown or other
  misc_feature (226)..(226): n is a, c, g, or t
  modified_base (363)..(363): a, c, t, g, unknown or other
  misc_feature (363)..(363): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagccccactccccaggtgcagctggtgcagtctggggctgaggtgaggagcctggggcctnagtgaaggtctcctgcaaggcttctggctacacctcaccggcgactatctccactgggtgcgacacggcccctggacaagggcttgagtggagtgggatggatcgaaccccctaacaagtggtggcaaacgaaactntgcacagaagtttcagggacgagggtcaccatgaccgagggacacgtccatcacgcacacgcctacagtggagcgtgagcaagctgacatctgacgacgacggcctatttacttacgttgttgcggtaggtaagttcggtttacgggttcggtcgttcggtttttccg

SEQ ID NO: 348299 - DNA, 542 bp, Homo sapiens
  misc_feature: GZ8MTXP01AYHI2.45.37.D04.1.454.CMB.2.raw
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagccccactccccaggtgcagctggtgcagtctgggggctgaggtgaggaagcctgggggcctcagtgaaggtctcctgcaaggcttctggctacaccttcaccggcgactatctccactgggtgcgacaggccccctggacaaggggcttgagtggatggggatggatcaaacccctaacaagtggtggacaacaaaaactatgcacagaagtttcgagggcagggtcaccatcgaccgagggacacgtcatcagcgacagcctacgagtggagctgagcagactgacatctgaacgacacggccttaagtttactaacgttgttgacgtaaggtattggttacccgggtggttcttgggtttccttttaacggg

SEQ ID NO: 348300 - DNA, 552 bp, Homo sapiens
  misc_feature: GZ8MTXP01BBQ6A.45.37.D04.1.454.CMB.2.raw
  modified_base (363)..(363): a, c, t, g, unknown or other
  misc_feature (363)..(363): n is a, c, g, or t
  modified_base (445)..(445): a, c, t, g, unknown or other
  misc_feature (445)..(445): n is a, c, g, or t
  modified_base (460)..(460): a, c, t, g, unknown or other
  misc_feature (460)..(460): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcagcttctggctacacctcaccggcgactatctccactgggtgcgacacggcccctggacgaagggcttggagtggagtgggatggatcaaaccccctaacaatgggtggcaaacaaactntgacacgagtaagtttcgaggggcaggggtcaccatcgaccgagggaccacgtccatcagcacacgccgtacagtggagtcngagcgagactgaacntcgaagaccgacgaccggccttaatttattaccgttggttgaacggtaggtgttacgggtttcggttggggttcggttttcgttttaacggg

SEQ ID NO: 348301 - DNA, 639 bp, Homo sapiens
  misc_feature: GZ8MTXP01AT18R.45.37.D04.1.454.CMB.2.raw
  modified_base (230)..(230): a, c, t, g, unknown or other
  misc_feature (230)..(230): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctnagtgaaggtctctgcaggcttcgtggctacaccttcaccggcgactatcctccacgtgggtcgcgacgacggcccctagggacaaggggtcttggagtggatgggatggactacccaaacctaagaagtggtgaacaacaactatgacacagtaacgttcgagggcagggtcacgagtacgaccgagggacacgtccatcgaacgcaacgacgggacctaacgacgtacgggacgtccgtaggaacgaccgaacgtaccgtaggaaccctagtaaccggtaacggaaccggtaacccgaccgggtaacctttaacgttttaacgttcgttcgggttaaggtaccgggttaagggttacggtttacggggttttaacccggggttcgggtttcccgggtttttcccgggg

SEQ ID NO: 348302 - DNA, 564 bp, Homo sapiens
  misc_feature: GZ8MTXP01D4EH0.45.37.D04.1.454.CMB.2.raw
  modified_base (322)..(322): a, c, t, g, unknown or other
  misc_feature (322)..(322): n is a, c, g, or t
  modified_base (363)..(363): a, c, t, g, unknown or other
  misc_feature (363)..(363): n is a, c, g, or t
  modified_base (438)..(438): a, c, t, g, unknown or other
  misc_feature (438)..(438): n is a, c, g, or t
  modified_base (442)..(442): a, c, t, g, unknown or other
  misc_feature (442)..(442): n is a, c, g, or t
  modified_base (458)..(458): a, c, t, g, unknown or other
  misc_feature (458)..(458): n is a, c, g, or t
  modified_base (461)..(461): a, c, t, g, unknown or other
  misc_feature (461)..(461): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtgggggcctcagtgaaggtctcctgcaaggcttctggctacaccttcaccggcgactatctccacgtgggtgcgacacggcccctggacaagggcttgagtgganggggatggatcaaacccctaacaatggtgcaacgaaaactntcgcaacagtaagttcgaaggggcagggtacacgatagaccgaggacacgtcatcagcacagcctacgagtgganacgngacgcagactgaactntcngaaccgcacgggtccttaagttttacttaacttggttcgacggtaaggtacgtttcggttttacccgggtggttccgtttcgggttttccgtttttaacgggg

SEQ ID NO: 348303 - DNA, 507 bp, Homo sapiens
  misc_feature: GZ8MTXP01AV1WA.45.37.D04.1.454.CMB.2.raw
  modified_base (313)..(313): a, c, t, g, unknown or other
  misc_feature (313)..(313): n is a, c, g, or t
  modified_base (355)..(355): a, c, t, g, unknown or other
  misc_feature (355)..(355): n is a, c, g, or t
  modified_base (483)..(483): a, c, t, g, unknown or other
  misc_feature (483)..(483): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctaccaacaataagaactactagcttggtaccagcagaaaccaggtcagcctcctaagctgctcatttacnggcatcgtacccgggatccggggtcccctgacgatcagtgcngcgggtctgggacagtattcactctcaccatcagcagcctgcaggctagagatggtggctagtttatgctgtcagctaatattattataacttccttcgtactttcggcctgggaccaagttcgaatntaacaaacgacttgtaagctaacg

SEQ ID NO: 348304 - DNA, 586 bp, Homo sapiens
  misc_feature: GZ8MTXP01CUEWK.45.37.D04.1.454.CMB.2.raw
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagccccactccccaggtgcagctggtgcagtcgtggggctgaggtgaggaagccgtggggcctcgagtgaaggtctcctgcaaggcttcgtggctacacccttcgaccggcgactatcctccacgtgggtgcgacgacggccccctggacgaagggtcttggagtggagtggggatggatcaaaccctaacaagtggtgacaacaaaaactatgacaacgaagtaaacgtttcgaaggggcagggtcacgagtcgaccgagggacacgtccatcagacacacgccctaacgagtggaacgcgtagacgcgaggacctgaactatccgagaaccgaacgacggtaccttagtttaactcgttgttggacgtaaggtagttcggtttaccgggtgttccgtttcgggtttccgttttaacggg

SEQ ID NO: 348305 - DNA, 769 bp, Homo sapiens
  misc_feature: GZ8MTXP01AB9AT.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggcctgtgtctcgtgggcgaggacggccaccatacaactgacaacgtccacgccagtagttagtttacgacacgcctaaccaaactaaataaacgtaaccttacgtacgtacgttacggtaaccagacgaaacgaaaccgaggtacacgtcctacgaagctcgctactactttacgcgggactacgttcccgtaacccggtaactccggttcccggtaccctacgaacccgttatacgaaagggtcggaaccgtagggtccggggttacgtacggggaactaggttactttacccaactttcctaaccaacctaactccgaacggcccgaacgtcccgttagaccggaacggtccgttaaagggaaaggttacggggttggggtccgggtacgtttaaacggtttttagtcggtccgttaggttaccaacggtaacttaaagtttacttttaaatttaacgttaacccttttccccggttaacccgtttacccggtttcccggtaccccggttaacggggttaaacccttaaaggggttgtaaacttaaacgttaaccgaaaaccggttacgttggggttcggtaacccg

SEQ ID NO: 348306 - DNA, 644 bp, Homo sapiens
  misc_feature: GZ8MTXP01CV2X6.45.37.D04.1.454.CMB.2.raw
  modified_base (228)..(228): a, c, t, g, unknown or other
  misc_feature (228)..(228): n is a, c, g, or t
  modified_base (378)..(378): a, c, t, g, unknown or other
  misc_feature (378)..(378): n is a, c, g, or t
  modified_base (582)..(582): a, c, t, g, unknown or other
  misc_feature (582)..(582): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctnagtgaaggtctcctgcaaggcttctggctacacctcaccggcgactatcctccagtgggtgcgacgacggccccgtggacgaagggcttggagtggagtgggatggataccaaaccccctaacgtaaagtggtacggacaaacaaaactntacgacaaacgaagtaaggtttcgagggtacgagggtaccaaccgagtacggaacccgaagggggaaccctaaccggtaccaacgtaccaacgaccaacgacgacccttaaacgagttacgggacgaccgtaggaacgacgaacgaccgtagacctattcgtaacggaaccgaccgacggttaccgttaaattttacgttacgnggttacggaacggaaaggtcgtttacgggtttaccgggttggtccgtttcgggtttttcccg

SEQ ID NO: 348307 - DNA, 532 bp, Homo sapiens
  misc_feature: GZ8MTXP01AK93V.45.37.D04.1.454.CMB.2.raw
  modified_base (339)..(339): a, c, t, g, unknown or other
  misc_feature (339)..(339): n is a, c, g, or t
  modified_base (358)..(358): a, c, t, g, unknown or other
  misc_feature (358)..(358): n is a, c, g, or t
  modified_base (460)..(460): a, c, t, g, unknown or other
  misc_feature (460)..(460): n is a, c, g, or t
  modified_base (495)..(495): a, c, t, g, unknown or other
  misc_feature (495)..(495): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacacctcaccggcgactatctccactgggtgcgacaggcccctggacaagggcttgagtggatgggatggatcaaccccctaanaatggtggcaaacaaactntgacaacagaagtttcgagggcaggggtcacatcgaccagggacacggtccatcagcacacgacctacagtgggaacgctgagccaaggactggacactcgngacgacgacggcctatttacttacgttgttcgcgnggtaattcggttaccggttggtcgttggttttaaccg

SEQ ID NO: 348308 - DNA, 524 bp, Homo sapiens
  misc_feature: GZ8MTXP01A0GBU.45.37.D04.1.454.CMB.2.raw
  modified_base (364)..(364): a, c, t, g, unknown or other
  misc_feature (364)..(364): n is a, c, g, or t
  modified_base (433)..(433): a, c, t, g, unknown or other
  misc_feature (433)..(433): n is a, c, g, or t
  modified_base (488)..(488): a, c, t, g, unknown or other
  misc_feature (488)..(488): n is a, c, g, or t
tcagacgcgatcgacacgaccggtgctcgatttagtagcatactgttggggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacacctcaccggcgactatctccactgggtgcgacacggcccctggacaaggggcttgagtggatgggatggatacaaccccctaacaagtggtaggcaaacaaactntgacacagaagtttcagggcagggtcaccatgaccaggacacgtcatcagcacagcctacagtggagcngagcaagactgactatcgaagacgacgacggcctaatttacttacgttgttacgngtaggtcttggttaccggttgtcgttcggttttccg

SEQ ID NO: 348309 - DNA, 584 bp, Homo sapiens
  misc_feature: GZ8MTXP01CYAK9.45.37.D04.1.454.CMB.2.raw
  modified_base (370)..(370): a, c, t, g, unknown or other
  misc_feature (370)..(370): n is a, c, g, or t
  modified_base (481)..(481): a, c, t, g, unknown or other
  misc_feature (481)..(481): n is a, c, g, or t
  modified_base (499)..(499): a, c, t, g, unknown or other
  misc_feature (499)..(499): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcagcttctggctacacctcaccggcgactatctccacgtgggtgcgacacggcccctggacaagggcttggagtggagtgggatgggataccaaaccccctaacaagtgggtaggacaaaacaaactntaggaccaacaagaacgtttacgaggggacgaggggtacacccgagtacgaaccgaacggggaacctaccggtaccaatcgacgacaacgacgaccttacagtaggacgcngagcaagacctgacatcngacgacacggccgttaaatttcttacgttggttcgcgtagggtaagttcggtttacgggttcggttcgttcgggtttttaacccg

SEQ ID NO: 348310 - DNA, 599 bp, Homo sapiens
  misc_feature: GZ8MTXP01C2554.45.37.D04.1.454.CMB.2.raw
  modified_base (228)..(228): a, c, t, g, unknown or other
  misc_feature (228)..(228): n is a, c, g, or t
  modified_base (523)..(523): a, c, t, g, unknown or other
  misc_feature (523)..(523): n is a, c, g, or t
  modified_base (555)..(555): a, c, t, g, unknown or other
  misc_feature (555)..(555): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctgaggtgaggaagccgtgggcctnagtgaaggtctcctgcaaggcttcgtggctacacctcgaccggcgactatcctccacgtgggtcgcgacgacggccccgtggacgaagggcttaggagttggagtgggatggactaccaaacccccctaagaagtggtacggaccaaaactaaactaagtgaccaaacgtaaggtaaacggtttcgaagggtacgaaggggtaccaaccgaagtcggaaccgaaggggacctaccgtccaatcgaacgcaactagaccctaatagtggacgccgtggacgacgtagactgaactntcgaagaacgacacgcttaagtttacttacgngttgaacggtagtgttcggttacggttgtcgttcggttttaacg

SEQ ID NO: 348311 - DNA, 581 bp, Homo sapiens
  misc_feature: GZ8MTXP01B018K.45.37.D04.1.454.CMB.2.raw
  modified_base (227)..(227): a, c, t, g, unknown or other
  misc_feature (227)..(227): n is a, c, g, or t
  modified_base (239)..(239): a, c, t, g, unknown or other
  misc_feature (239)..(239): n is a, c, g, or t
  modified_base (249)..(249): a, c, t, g, unknown or other
  misc_feature (249)..(249): n is a, c, g, or t
  modified_base (377)..(377): a, c, t, g, unknown or other
  misc_feature (377)..(377): n is a, c, g, or t
  modified_base (411)..(411): a, c, t, g, unknown or other
  misc_feature (411)..(411): n is a, c, g, or t
  modified_base (429)..(429): a, c, t, g, unknown or other
  misc_feature (429)..(429): n is a, c, g, or t
  modified_base (444)..(444): a, c, t, g, unknown or other
  misc_feature (444)..(444): n is a, c, g, or t
  modified_base (455)..(455): a, c, t, g, unknown or other
  misc_feature (455)..(455): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctgaggtgaggagccgtgggcctnagtgaggtctcngcaggcttcnggctacacctcgaccggcgactatctccacgtgggtgccgacgaccggccccgtaggacgaagggtcttggaggtggagtgggatggactaccgaaaccccctaagaagtggtagacaaaacaaactntgacacgaagtaagttcgagggcaggtcacgtancgacgaggacacgtccancagcacacgcctaanagtggacgcgngacgcgaacgactagactacgtcgaacggaaccgaccgtacggaccttaaattttacgttacgttgttacggaacggtaggtgtttacgggtttacccgggttggttccgtttcggtttttcccgg

SEQ ID NO: 348312 - DNA, 564 bp, Homo sapiens
  misc_feature: GZ8MTXP01CYFU1.45.37.D04.1.454.CMB.2.raw
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (362)..(362): a, c, t, g, unknown or other
  misc_feature (362)..(362): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctnagtgaaggtctctgcaaggcttcnggctacacctcaccggcgactatctccacgtgggtgcgacacggcccctggacaagggcttgagtgagtggatggatacaaaccccctaacaagtggtaggacaaacaaactntagcaacagtaagttcgagggcagggtcaaccagtcgacgaggacacgtcagtcacgacacgacgacacaagtggaacgctgacgacaagactagacacgtctaacgaaccgacgaccggccttaaattttattaacgttgacgtaaccggtaggtaacgtttcgggtttacccgggttggtccgtttcgggtttttcccgg

SEQ ID NO: 348313 - DNA, 686 bp, Homo sapiens
  misc_feature: GZ8MTXP01DLVC8.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagctggggcctcagtgaaggtctcctgcaaggcttctggctacacctcaccggcgactatctccacgtgggtgcgacacggcccctggacaagggcttgagtggatgggatggatcaaaccccctaacaatggtgacaaacaaaactgtagacaacgagtaaagtttcgaaggggtcaaggggttcaacccgaagtacgaacccgaaggggaacctaaccggtacccaagtccaacggaccaacgaacggaccttaacgaagttggggaacgaccgttaggaacgacgaaacggaacgttacggaaacctaacttccgtaacgggaaccgaaaccgaacccggggttaaccccgttaaatttttaaaccgttaaaccgttgggttacggaacccgggtaacgggttaaggttttaccggggttttaacccgggggttcgggtttcccgttttcggggttttttttaaccccggg

SEQ ID NO: 348314 - DNA, 518 bp, Homo sapiens
  misc_feature: GZ8MTXP01AZE9Q.45.37.D04.1.454.CMB.2.raw
  modified_base (359)..(359): a, c, t, g, unknown or other
  misc_feature (359)..(359): n is a, c, g, or t
  modified_base (437)..(437): a, c, t, g, unknown or other
  misc_feature (437)..(437): n is a, c, g, or t
  modified_base (452)..(452): a, c, t, g, unknown or other
  misc_feature (452)..(452): n is a, c, g, or t
  modified_base (459)..(459): a, c, t, g, unknown or other
  misc_feature (459)..(459): n is a, c, g, or t
  modified_base (502)..(502): a, c, t, g, unknown or other
  misc_feature (502)..(502): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaggtctcctgcaaggcttctggctacacctcaccggcgactatctccactgggtgcgacacggcccctggacaagggcttgagtggatggggatggatcaaccccctaacaagtggtggcaaacaaactntgacacagtaagtttcgagggcagggtcaccagtcgaccaggggacacggtcatcagcacagcctacagtggagctgngcagactgacatccngacgacncggcctatttattacgttgttgcggagtaagttcggttacggnggtcgttggttttccg

SEQ ID NO: 348315 - DNA, 516 bp, Homo sapiens
  misc_feature: GZ8MTXP01CE535.45.37.D04.1.454.CMB.2.raw
  modified_base (362)..(362): a, c, t, g, unknown or other
  misc_feature (362)..(362): n is a, c, g, or t
  modified_base (434)..(434): a, c, t, g, unknown or other
  misc_feature (434)..(434): n is a, c, g, or t
  modified_base (481)..(481): a, c, t, g, unknown or other
  misc_feature (481)..(481): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacacttcaccggcgactatctccactgggtgcgacacggcccctggacaagggcttgagtggatgggatggatcaacccccctaacaagtggtggacaaacgaaactntgcacgagaagtttcgagggcagggtcaccatgacagggacacgtcatcagcacacgacctacagtggagcngagcagactgacatctgacgacacggcctatttattacgttgttcgngagtaagttggttaccggttgtcgttggttttccg

SEQ ID NO: 348316 - DNA, 563 bp, Homo sapiens
  misc_feature: GZ8MTXP01D6HPZ.45.37.D04.1.454.CMB.2.raw
  modified_base (363)..(363): a, c, t, g, unknown or other
  misc_feature (363)..(363): n is a, c, g, or t
  modified_base (400)..(400): a, c, t, g, unknown or other
  misc_feature (400)..(400): n is a, c, g, or t
  modified_base (421)..(421): a, c, t, g, unknown or other
  misc_feature (421)..(421): n is a, c, g, or t
  modified_base (449)..(449): a, c, t, g, unknown or other
  misc_feature (449)..(449): n is a, c, g, or t
  modified_base (451)..(451): a, c, t, g, unknown or other
  misc_feature (451)..(451): n is a, c, g, or t
  modified_base (543)..(543): a, c, t, g, unknown or other
  misc_feature (543)..(543): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacacctcaccggcgactatctccacgtgggtgcgacaggcccctgacgaagggcttgagtgagtggatggatcaaccccctaacaagtggtaggccaaaacaaacttngacacgaagtaagtttcgagggtcagggtccaccganacgaccgagggacacgtccancacgcaacgtacacctacagtaggacgngngaggccaaggacctaggacctaatcaacgaacgaccgacggcctaattttaacttacgttgttggcgaggtaacgttacggtttacccgggnggttcgttcggtttttccgg

SEQ ID NO: 348317 - DNA, 543 bp, Homo sapiens
  misc_feature: GZ8MTXP01B3C6Y.45.37.D04.1.454.CMB.2.raw
  modified_base (251)..(251): a, c, t, g, unknown or other
  misc_feature (251)..(251): n is a, c, g, or t
  modified_base (365)..(365): a, c, t, g, unknown or other
  misc_feature (365)..(365): n is a, c, g, or t
  modified_base (417)..(417): a, c, t, g, unknown or other
  misc_feature (417)..(417): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttcnggctacacctcaccggcgactatctccacgtgggtgcgacacggcccctggacaagggcttgagtggatgggatggatacaaaccccctaacaagtggtaggacaaacaaactntgacaacagtaagtttcgagggacagggtcaccatcgacgaggacacgtcancagcactacgctacagtggagcgtgacgcaagactgacatcgtaacgaacgacgacggacctaagtttacttacgttggttcgaaggtagtaagttcggttacggttggtccgtttcggttttccg

SEQ ID NO: 348318 - DNA, 774 bp, Homo sapiens
  misc_feature: GZ8MTXP01AKVW6.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctcctgcaggctctggctacacctcaccggcgactatcctccacgtggggtgccgaccgacggcccccgtggaccgaaggggcttggaggtgggatgggggattgggactaccgaaacccccctaacgaaagttgggtacggacaaaaccaaaccgtaatcgggaccaaccgtaaggtaaacggttttcgaaacgggggcgtaacggggttaccaaccccgtaagttaccgggaaacccggaaacggggggaaccctaacccgggttacccgaaactaaccgaaaccgggtaccaaaccgtaacccggaaccccgttaaaccgaaaggttcgggggaaacggtcccgtacggaaggacccgtaaggtaacccgtgggaaaccttaacgccgttaaccgggaaacccggacccggaaaccgggttacccctttaaaggttttaacttaacccgttgggttccggaaccggggtaagggttcgttttacggggttttacccgggggttgggttccggttttcgggggttttttccccgg

SEQ ID NO: 348319 - DNA, 519 bp, Homo sapiens
  misc_feature: GZ8MTXP01BYMIQ.45.37.D04.1.454.CMB.2.raw
  modified_base (438)..(438): a, c, t, g, unknown or other
  misc_feature (438)..(438): n is a, c, g, or t
  modified_base (454)..(454): a, c, t, g, unknown or other
  misc_feature (454)..(454): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaggtctcctgcaggcttctggctacaccttcaccggcgactatctccactgggtgcgacgaggcccctggacaagggcttgagtggatgggatggatccaaacctaacagtggtaggacaacaactatagacacgtagaagtttcgagggcagggtcaaccagtacgaccgaagggacacgtccatcagacacaggactacatggancgtgagcagactgacntcgtgacgacgacggcctatttagttcttgtgcgaaggtgttcgtttacgggtcgttcgtttcgg

SEQ ID NO: 348320 - DNA, 521 bp, Homo sapiens
  misc_feature: GZ8MTXP01DMXCB.45.37.D04.1.454.CMB.2.raw
  modified_base (396)..(396): a, c, t, g, unknown or other
  misc_feature (396)..(396): n is a, c, g, or t
  modified_base (435)..(435): a, c, t, g, unknown or other
  misc_feature (435)..(435): n is a, c, g, or t
  modified_base (452)..(452): a, c, t, g, unknown or other
  misc_feature (452)..(452): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacacctcaccggcgactatctccactgggtgcgacacggcccctggacaagggcttgagtggagtgggatggatcaaaccccctaacaaagtggtaggacaaacaaactgtgacacgagaagtttcgagggcagggtcacancgacgaggacacgtcatcagcacacgctacagtggagcngagcagactgacatcgngacgacgacggcctaatttattacgttgttgcgagtaacttggttaccggttggtcgttcggttttccg

SEQ ID NO: 348321 - DNA, 530 bp, Homo sapiens
  misc_feature: GZ8MTXP01AZCUI.45.37.D04.1.454.CMB.2.raw
  modified_base (345)..(345): a, c, t, g, unknown or other
  misc_feature (345)..(345): n is a, c, g, or t
  modified_base (461)..(461): a, c, t, g, unknown or other
  misc_feature (461)..(461): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccacgtgggtgcgacaggcccctggacaagggcttggagtggatgggatggatacccaaccctaanaagtggtaggacaacaactatcgacacgagtaagtttcgagggcagggtacaccgatcgacgagggacacgtccatcagacacgaggcctacagtggagctgacgcagactagacntcgtgacgacgacggtacctatttagttcttgtgacgaaggtacgtggttaccggtggttcgtttcggg

SEQ ID NO: 348322 - DNA, 578 bp, Homo sapiens
  misc_feature: GZ8MTXP01CIROZ.45.37.D04.1.454.CMB.2.raw
  modified_base (342)..(342): a, c, t, g, unknown or other
  misc_feature (342)..(342): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcgagtgaaggtctctgcaaggcttctggctacacctcgaccggcgactatcctccacgtgggtgcgacacggcccctggacaagggcttgagtggagtgggatggatcaaccccctanagtggtgcaaacaaactngcanagtagttcgagggcagggtcacagtcgaccgagggacacgtcatcagacacacgaccacagtgacgcgtgagcgacgactggaactcgtacgtaacggaaccgaaccgtaccggacccttaaagttttacttaaccgttggttacggtaaccgggtaggttaacgtttcggggttttaccgggttcggttccgtttcgggttttttaaccccgg

SEQ ID NO: 348323 - DNA, 603 bp, Homo sapiens
  misc_feature: GZ8MTXP01BOGBM.45.37.D04.1.454.CMB.2.raw
  modified_base (344)..(344): a, c, t, g, unknown or other
  misc_feature (344)..(344): n is a, c, g, or t
  modified_base (364)..(364): a, c, t, g, unknown or other
  misc_feature (364)..(364): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacacctcaccggcgactatctccacgtgggtgcgacacggcccctggacaagggcttggagtggagtgggatggatcaaccccctaanaagtggtgacaaacaaactntgacacgagtaagtttcgaggggcagggtcaacagtcgaacgagggacacgtccatcancaacncgacctacagtcggaagctaggacgacgtaacgacgtacggaactacgtcgtaacggaaccgaaaccggtacccggttaccttaaaggttttacttaaaccgttggttcggtaaccggagggttaacgtttacgggtttaccgggttggttccgtttcgggttttttaaccccgg

SEQ ID NO: 348324 - DNA, 573 bp, Homo sapiens
  misc_feature: GZ8MTXP01E1HHR.45.37.D04.1.454.CMB.2.raw
  modified_base (368)..(368): a, c, t, g, unknown or other
  misc_feature (368)..(368): n is a, c, g, or t
  modified_base (531)..(531): a, c, t, g, unknown or other
  misc_feature (531)..(531): n is a, c, g, or t
tcagacgcgatcgacacgaccggtgctcgatttagtagcatactgttggggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacacctcaccggcgactatcctccacgtgggtgcgacacggcccctggacaagggcttgagtggagtgggatggataccaaaccccctaacaagtggtgacaaacaaactntagacaacagtaagtttcgagggtcacgggtacaccgagcgaccgaggggaaccacggtaccatcagacaacacgacctaacgagtagggaacgccgtagacgacctaaggaccttggaaccatcgaagacgacgacggacctatttaattacgttgttacgngaggtaacgttcggttaccggttggtaacgttggttttcccg

SEQ ID NO: 348325 - DNA, 529 bp, Homo sapiens
  misc_feature: GZ8MTXP01CMZN2.45.37.D04.1.454.CMB.2.raw
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactggtgcgacaggcccctggacagggctgagtggatgggatggatcccgaaaccctaacgaagtggtaggacacgaactatgcacagaagtttcagggcagggtcaccagtcgacgaggacacgtcatcagctacagacctacataggagcgtgagccagactgacatcgtacgacgacaccgggtacctatttacgttacttggtgacgtaaggtagtcggtttaccggtggttcgttttaacggg

SEQ ID NO: 348326 - DNA, 507 bp, Homo sapiens
  misc_feature: GZ8MTXP01EGSXO.45.37.D04.1.454.CMB.2.raw
  modified_base (227)..(227): a, c, t, g, unknown or other
  misc_feature (227)..(227): n is a, c, g, or t
  modified_base (237)..(237): a, c, t, g, unknown or other
  misc_feature (237)..(237): n is a, c, g, or t
  modified_base (336)..(336): a, c, t, g, unknown or other
  misc_feature (336)..(336): n is a, c, g, or t
  modified_base (405)..(405): a, c, t, g, unknown or other
  misc_feature (405)..(405): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
  modified_base (441)..(441): a, c, t, g, unknown or other
  misc_feature (441)..(441): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagctggggcctnagtgaggtcnctgcaaggctctggctacacctcaccggcgactatctccactgggtgcgacacggcccctggacaagggcttgagtggatgggatggatccgaacctanaatggtaggacacaactatgacacagtaagtttcgagggtcagggtcaccatgacgagggacacgtcancagcacagcctanatgganctgagacagtactgacntctgacgacgacggcctaagtttattacttggtcgagtaagtgttgttacggtggttcgtttcggg

SEQ ID NO: 348327 - DNA, 590 bp, Homo sapiens
  misc_feature: GZ8MTXP01B9USW.45.37.D04.1.454.CMB.2.raw
  modified_base (228)..(228): a, c, t, g, unknown or other
  misc_feature (228)..(228): n is a, c, g, or t
  modified_base (369)..(369): a, c, t, g, unknown or other
  misc_feature (369)..(369): n is a, c, g, or t
  modified_base (473)..(473): a, c, t, g, unknown or other
  misc_feature (473)..(473): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctggaggtgaggaagcctggggcctnagtgaaggtctcctgcaaggcttctggctacacctcaccggcgactatctccacgtgggtgcgacacggcccctggacaagggcttgagtggagtggatggatacaaaccccctaacaaagtgggtggacaaaacaaactntagacaacgagtaagtttcgaagggcaggggtcaccagtcgaccagggacacgtcatcagcaacacgcctaacagtggacgctgacgcgtaagcctagactacncgtaaggaaccgacgtaccgggccttaaatttacgttacgttgggttacggtcgggtaaagggttgtttcggggtttacccgggttggggttcccgttttcgggtttttaacccggg

SEQ ID NO: 348328 - DNA, 586 bp, Homo sapiens
  misc_feature: GZ8MTXP01CZD8U.45.37.D04.1.454.CMB.2.raw
  modified_base (344)..(344): a, c, t, g, unknown or other
  misc_feature (344)..(344): n is a, c, g, or t
  modified_base (365)..(365): a, c, t, g, unknown or other
  misc_feature (365)..(365): n is a, c, g, or t
  modified_base (412)..(412): a, c, t, g, unknown or other
  misc_feature (412)..(412): n is a, c, g, or t
  modified_base (471)..(471): a, c, t, g, unknown or other
  misc_feature (471)..(471): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctgagtgaaggtctcctgcaaggcttcgtggctacacctcaccggcgactatctccactgggtgcgacacggcccctggacaaggcttgagtggagtggatggatacaaaccccctaanagtggtcggacaaacaaactntaggacaaacgtaagtaagtttacgagggacgacgggtacaaccganacgaccgagggaaccacggtaccagtcagacaactacgaccgtaacagaggacgaccgngagcaacgactagaccatcgaagaccgacgtacggccttaattaacttacgttgttaccgtaaggtaggtaacgtttcgggttaaccgttcgggttcgttcgggttttttcccgg

SEQ ID NO: 348329 - DNA, 543 bp, Homo sapiens
  misc_feature: GZ8MTXP01AB1NS.45.37.D04.1.454.CMB.2.raw
  modified_base (367)..(367): a, c, t, g, unknown or other
  misc_feature (367)..(367): n is a, c, g, or t
  modified_base (446)..(446): a, c, t, g, unknown or other
  misc_feature (446)..(446): n is a, c, g, or t
  modified_base (492)..(492): a, c, t, g, unknown or other
  misc_feature (492)..(492): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacgaccttcaccggcgactatctccactgggtgcgacaggccccctggacaagggcttggagtggatgggggatggatcgaaccccctaacaagtgggtggcaaacaaacctntgcacagtaagtttcaggggcaggggtcaaccatacgaccaggggacacgtccatcacgcacacgcctacagtggagcngacgcagtactgacatcaagacgacacggcctaagtttatttacgngttcgcggtaggtaacttggttaccggttggtaacgttggtttttaacccg

SEQ ID NO: 348330 - DNA, 763 bp, Homo sapiens
  misc_feature: GZ8MTXP01CF6AB.45.37.D04.1.454.CMB.2.raw
tcagacgcgatcgacacgaccggtgctcgattttagtagcatactgttggggtttgggggcatcacccagcaaccacatctgtcctctagagaatccccctgagagctccgttcctcaccatggactggacctggaggatcctcttcttggtggcagcagccacaagagcccactccccaggtgcagctggtgcagtcgtggggctgaggtgaggagcgtggggcctcagtgaagttctcctgcaaggtcttcgtggctacaccttcgaccggcgactatctccacgtgggtcgcgacacggtcccccgtaggacaaggggtcttggaggtagggagtggggacttagggactaccgaaaccctaaaccgaagtggggtacggaccaaacgtaaaaaaacccgttagtcgacccgtaaacgtaaacgggttaaacggttttaccgaacgggggtaccgaaacgggggttacccaaacccgaacgttaccggaaacccggtaacgggtaaacccgaacccggttacctaaacgtaccgaacggaccaaaccgttaaccggaacccttaaacccgtaaggttacggggtaaacgcccggttaggaaccgaccgtaaggaacccttaggaaacctacgttaccgttacggaaaccgaacgttacccgggtaaccctttaatttaaacgtttaaccgttggttacggttaccggtaaggtacgtttcggttacggtggttccgtttcggtttaaaaccgttttcggg

SEQ ID NO: 348331 - DNA, 577 bp, Homo sapiens
  misc_feature: GZ8MTXP01BLXAE.45.37.D04.1.454.CMB.2.raw
  modified_base (318)..(318): a, c, t, g, unknown or other
  misc_feature (318)..(318): n is a, c, g, or t
  modified_base (484)..(484): a, c, t, g, unknown or other
  misc_feature (484)..(484): n is a, c, g, or t
  modified_base (509)..(509): a, c, t, g, unknown or other
  misc_feature (509)..(509): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgtttagacagctacaaacaataagaactactagcttaggtaccagcaagaaaccaggtacagcctacctaagctgctactatttacgngggacagtccgtaacccggggaacgtccccgggggtccccctacggaccgtactttcgaggttcgggaccgaacgggccggggtccgtggggacctaggtactttcaaccttctacaccctatcaagcacgcctgcaggctagaagagtgggtaggtctaagtttntgtctgtcaagtctaattatttatnttcttccttcgtacttcgggacccttgggaaccagttgaatagtaacaaccgattagtggttctaacg

SEQ ID NO: 348332 - DNA, 670 bp, Homo sapiens
  misc_feature: GZ8MTXP01A3O9I.45.37.D04.1.454.CMB.2.raw
  modified_base (365)..(365): a, c, t, g, unknown or other
  misc_feature (365)..(365): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaagtctcctgcaaggcttctggctacacctcaccggcgactatctccactgggtgcgacaggcccctggacaaggcttgagtggatgggatggataccaaaccccctaacaagtggtaggcaaaacgaaaacctntggactaaccaaggaagttttaccgaggggtaccaggggttccaaccgatacggaaccgaagggaacccgaaccggttaccaactaccgaacggaccaaccaacggacccttaacaacgttagggaacgccgtagacgaccgtaacgacttaggaacctacgtaccgttaacggaaccggaaccgaaccggggttaccccgttaattttaacgtttaacccgttggttaccggtaacggtaagggttaacgttcgggttttaacccggggttacggggttccgtttcgggggtttttttccccgg

SEQ ID NO: 348333 - DNA, 607 bp, Homo sapiens
  misc_feature: GZ8MTXP01C1RON.45.37.D04.1.454.CMB.2.raw
  modified_base (415)..(415): a, c, t, g, unknown or other
  misc_feature (415)..(415): n is a, c, g, or t
  modified_base (432)..(432): a, c, t, g, unknown or other
  misc_feature (432)..(432): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcgtggggcctcagtgaaggtctcctgcaaggcttcgtggctacacctcgaccggcgactatctccacgtgggtgccgacacggcccctggacaagggcttgagtggagtgggatggactaccaaaccccctaaacgaaagtggtaggacaaaactaaactaatcgacaacgaagtaagtttacgagggcgagggtcacgancgacagggacacgtcancagcaactacgcctaactacgaggacgacgtgaacgcaaacggactacgaactacgtcgtaagaaccgaaccgaccgggttacctaaacttttaacgttaacgttcgttaggaacgtagggtaacgtttcgggtttacccgggttgggttaaccgtttcgggttttttaacccgg

SEQ ID NO: 348334 - DNA, 545 bp, Homo sapiens
  misc_feature: GZ8MTXP01BJQ0B.45.37.D04.1.454.CMB.2.raw
  modified_base (341)..(341): a, c, t, g, unknown or other
  misc_feature (341)..(341): n is a, c, g, or t
  modified_base (360)..(360): a, c, t, g, unknown or other
  misc_feature (360)..(360): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcagtgaaggtctcctgcaaggcttctggctacacctcaccggcgactatctccactgggtgcgacaggcccctggacaagggcttgagtggatgggatggataccaaccccctaanaatggtggcaaacaaactntgacacagagtttcagggcagggtcacatgaccgagggtacacgtccatcagcacagcctacagtggacgctgacgcgacggactagacatcctaaggacgacacgggcctaatttacgttacgttggttacgcggtaggtaacgttcgggtttaccgggttcggtcgtttcgggtttttcccgg

SEQ ID NO: 348335 - DNA, 528 bp, Homo sapiens
  misc_feature: GZ8MTXP01C95WZ.45.37.D04.1.454.CMB.2.raw
  modified_base (458)..(458): a, c, t, g, unknown or other
  misc_feature (458)..(458): n is a, c, g, or t
  modified_base (487)..(487): a, c, t, g, unknown or other
  misc_feature (487)..(487): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcagtgaaggtctcctgcaaggcttctggctacaccttcaccggcgactatctccactggtgcgacaggcccctggacaagggcttgagtggagtgggatggatcccaaaccctaacaagtggtaggaaccaacaactatgacacagaagtttcgagggcagggtcaccagtcgaaccgagggacacgtcagtcacgcacaggcctacatggagcgtgagccagtactgacntcagacgacacggtactatttaacttcgngtggcgtaaggtagttcggtttacggtgttcgttttccggg

SEQ ID NO: 348336 - DNA, 548 bp, Homo sapiens
  misc_feature: GZ8MTXP01B3MQX.45.37.D04.1.454.CMB.2.raw
  modified_base (457)..(457): a, c, t, g, unknown or other
  misc_feature (457)..(457): n is a, c, g, or t
tcagacgcgatcgacacgaccggtgctcgatttagtagcatactgttgggtttgggggcatcaccccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagccgtgggggcctcagtgaaggtctcctgcaaggctctggctacaccttcaccggcgactatctccactgggtcgcgacacggccccctggacaagggcttggagtggatggggatggatacaaaccctaacaatggtgacaacaaaaactatgacactagtaaagtttcgaggggcaggggtcaccgatcgaccgaggacacggtccatcagcacagccctacgatggagcgtgagcagacngtacatctgaacgacacggccttagtttactcttgttgcgtaaggtattcgggtttaccggtggttccgttcggttttccgttttaacggg

SEQ ID NO: 348337 - DNA, 519 bp, Homo sapiens
  misc_feature: GZ8MTXP01CDL7P.45.37.D04.1.454.CMB.2.raw
  modified_base (350)..(350): a, c, t, g, unknown or other
  misc_feature (350)..(350): n is a, c, g, or t
  modified_base (395)..(395): a, c, t, g, unknown or other
  misc_feature (395)..(395): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (488)..(488): a, c, t, g, unknown or other
  misc_feature (488)..(488): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacacggcccctggacaagggcttgagtggatgggatggataccgaacctaacaaatggnggacaacaactatgacacagaagtttcagggtcagggtcaccagngacagggacacgtccatcagcacgacgctaacangggaangngagacgacgacacgacatctcgacgacgacgtactattacgttacttgtgngaagtagttacggttacggtcggttcgttcg

SEQ ID NO: 348338 - DNA, 570 bp, Homo sapiens
  misc_feature: GZ8MTXP01CZA7V.45.37.D04.1.454.CMB.2.raw
  modified_base (483)..(483): a, c, t, g, unknown or other
  misc_feature (483)..(483): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttctggctacacctcaccggcgactatctccacgtggtgcgacacggcccctggacaagggcttgagtggagtgggatggactacaaacccccctaacgaaagtggtacggacaaaacaaactaactggaccaactaaaggtaaacgtttcggaggggacgagggtaccaacgacgacggaaccgaggggaacccacggtaccatcagacaacgacgacctacagtaggagcgngacgcaaggactgacatcgaacgacgacacggcctaagttattacgttgacgtgagtgttcggtacggttgtccgttgttttaaccg

SEQ ID NO: 348339 - DNA, 526 bp, Homo sapiens
  misc_feature: GZ8MTXP01AOQLK.45.37.D04.1.454.CMB.2.raw
  modified_base (359)..(359): a, c, t, g, unknown or other
  misc_feature (359)..(359): n is a, c, g, or t
  modified_base (458)..(458): a, c, t, g, unknown or other
  misc_feature (458)..(458): n is a, c, g, or t
  modified_base (461)..(461): a, c, t, g, unknown or other
  misc_feature (461)..(461): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacacctcaccggcgactatctccactgggtgcgacacggcccctggacaagggcttgagtggagtgggatggatacaaaccccctacaatggtggcaaacaaactntcgacaacgagtaagtttcgagggacagggtcaccgatcgaccgagggacacgtccagtcagacacacgccgtacagtggagctgagcagacctgaccntcngacgacaccggctatttacttacgttgttgcgaggtcttggttacggttgtcgttcggttttccg

SEQ ID NO: 348340 - DNA, 650 bp, Homo sapiens
  misc_feature: GZ8MTXP01DS8HL.45.37.D04.1.454.CMB.2.raw
  modified_base (479)..(479): a, c, t, g, unknown or other
  misc_feature (479)..(479): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagacgcccactcccaggtgcagctggtgcagtcgtggggctggaggtgaggaacgccgtggggcctcgagtggaaggtctcctgcgaaggcttctggctacacctcaccggcgactactctccacgtgggtcgcgacacggcccctggaccaagggcttggaggttggagtgggatggactacctaaaacccccctaaacgaaagtgggtacggacaaaactaaaactaactgacaacgaaagtaaaggtttaccgaagggggactaggggacaacccgaagacggaaccgaaggggaaccaccggttaccaancgacgcaacacgaccttacgagtcggagcctaggacgacgaacgaccgtgaacctattcgaaggaaccgacgtaacccgggttcctaaagttttacttaaccgttcggttagtaaccggagggttaacgttgggtttaccggttcggtcggttttaacggttttttcccgg

SEQ ID NO: 348341 - DNA, 536 bp, Homo sapiens
  misc_feature: GZ8MTXP01EMMGY.45.37.D04.1.454.CMB.2.raw
  modified_base (362)..(362): a, c, t, g, unknown or other
  misc_feature (362)..(362): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacacctcaccggcgactatctccactgggtgcgacacggcccctggaccaagggcttgagtggagtgggatggatcaaaccccctaacaagtggtggacaaacaaactntagcaacagtaagtttcaggggcagggtcaccatcgaccagggacacgtccatcagcacacgacctacaagtggacgctgagccgaagtacctgacagtcgtgaacgacacggttcctaatttacttacgttgttgcgaggtcttcggtttacgggttgtcgttcggttttccg

SEQ ID NO: 348342 - DNA, 517 bp, Homo sapiens
  misc_feature: GZ8MTXP01BFX0I.45.37.D04.1.454.CMB.2.raw
  modified_base (230)..(230): a, c, t, g, unknown or other
  misc_feature (230)..(230): n is a, c, g, or t
  modified_base (344)..(344): a, c, t, g, unknown or other
  misc_feature (344)..(344): n is a, c, g, or t
  modified_base (363)..(363): a, c, t, g, unknown or other
  misc_feature (363)..(363): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctnagtgaaggtctcctgcaaggcttctggctacaccttcaccggcgactatcctccacgtgggtgcgacacggcccctggacagggcttgagtggatgggatggatcccaacctanaagtggtgacaacaactangcacgagtagttcgagggcagggtcacatcgacgagggacacgtccatcagcacaggactacgagtggagcgtgagcagtctgacatctgacgacacggctaagtttacttcgttgtgcggaagtcgttcggtttaccggtggttcgtttcggg

SEQ ID NO: 348343 - DNA, 533 bp, Homo sapiens
  misc_feature: GZ8MTXP01CSNPT.45.37.D04.1.454.CMB.2.raw
  modified_base (285)..(285): a, c, t, g, unknown or other
  misc_feature (285)..(285): n is a, c, g, or t
  modified_base (484)..(484): a, c, t, g, unknown or other
  misc_feature (484)..(484): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggatctggaggatcctcttcttggtggcagcagccacaagagcccactcccaggtgcagctggtgcagtctggggctgaggtgaggaagcctggggcctcagtgaaggtctcctgctaaggttctggctacaccttcaccggcgactatctccactgggtncgacacggcccctggacaagggcttgagtggatgggatggatcaaacctaacaagtggtggacaacaaaaaactatcgacaacgaaggtaagtttcgaggggcagggtcaccagtcggacgggacacgtcatcagcacagacctacaggtggagctagagcagactagacatcgagacgaacacggctattagtactgngcgaggtaatggtttaaccgggtgtacgttcggtttccgtttgaaccgg

SEQ ID NO: 348344 - DNA, 742 bp, Homo sapiens
  misc_feature: GZ8MTXP01C0MC9.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctcctgcaaggcttctggctacacctcaccggcgactactctccacgtgggtgccgacgacggccccctagggacgaagggtcttagaggttggagtggggataggactacgaaaccccccctaaagaagtgggtacggactaaaaccaaaactaagtacggactaaaccgaaggtaaacggtttaccgaaggggaccgtaacggggttaccaaacccgtaagtacgggaaccccgtaaaggggggtaaccccaaacccgggttccccaaaggttacccaaacggtacccaaaccgtaaccggaccccggtttaaaacgtaacggtacgggaacgtaccgtaggacgacgtaaacggtacgtagaacctacgtacgtaacggaacccgttaaccgtaccggttaacctttaaacgttttaacgtttacgttgggttacggtaacgggtacggttaacggtttaccgggtttacgggttcggtttccggttttcgggtttttaaccg

SEQ ID NO: 348345 - DNA, 661 bp, Homo sapiens
  misc_feature: GZ8MTXP01AQP3H.45.37.D04.1.454.CMB.2.raw
  modified_base (361)..(361): a, c, t, g, unknown or other
  misc_feature (361)..(361): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacacctcaccggcgactatctccacgtgggtcgcgacacggcccctggacaagggcttgagtggatgggatggatcaacccctacgatggtaggacaaacaaactntgacaacctaggtaagtttcgagggcgacgggtacaccgatcggaaccgaggggaacacggtaccacgcaacgacaacgacgtaccccttaacgagttaccggggaagtccgtaggaacgacccgggaaagaccgttacggaaacccgtaaattccgtaacgggtaaacccggaaccgtacccgggttaccccgttaaattttaacgttacccgttgggttaccggtaagggtaaccgggttaagtttacggggtttaacccgggttcgggttccggtttcgggtttttttaaccccggg

SEQ ID NO: 348346 - DNA, 535 bp, Homo sapiens
  misc_feature: GZ8MTXP01ETWF2.45.37.D04.1.454.CMB.2.raw
  modified_base (353)..(353): a, c, t, g, unknown or other
  misc_feature (353)..(353): n is a, c, g, or t
  modified_base (376)..(376): a, c, t, g, unknown or other
  misc_feature (376)..(376): n is a, c, g, or t
  modified_base (426)..(426): a, c, t, g, unknown or other
  misc_feature (426)..(426): n is a, c, g, or t
  modified_base (516)..(516): a, c, t, g, unknown or other
  misc_feature (516)..(516): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagcctgggggcctcgagtgaaggtctcctgcaaggcttctggctacacctcaccggcgactatctccacgtgggtgcgacgacggcccccgtggacgaagggcttggaggtggagtggggatggatccaaccccctaanaaagtggtaggacaaacaaactntagacacagaagtttcgagggtcagggtcacatcgacgaggacacgtcancagcacacgactacagtcggagctgacgcagactgacatcaagacgacacggctatttattcgttgttgaacgaggtaattggtttacgnggtcgttcggttttaaccg

SEQ ID NO: 348347 - DNA, 604 bp, Homo sapiens
  misc_feature: GZ8MTXP01A41G5.45.37.D04.1.454.CMB.2.raw
  modified_base (224)..(224): a, c, t, g, unknown or other
  misc_feature (224)..(224): n is a, c, g, or t
  modified_base (364)..(364): a, c, t, g, unknown or other
  misc_feature (364)..(364): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagctggggcctnagtgaaggtctcctgcaaggcttctggctacacctcaccggcgactatctccactgggtgcgacacggccccctggacaagggcttgagtggatgggatggatcgaaacccccctaacaagtggtggacaaacaaaactntagacacagtaagtttcgaggggcagggtcaccgatcgaccgagggacacgtccagtcagcactacgacctacgagtagggacgcgtaggacgcgaacgacgtacggactacgttaccgtaaggaacccgaaccggaaccgggttacccttaaattttaacgtttaaccgttggttacggaacggtaggtaaggtttcgggtttaccggggttcgggttcgttttcgggttttttcccgg

SEQ ID NO: 348348 - DNA, 585 bp, Homo sapiens
  misc_feature: GZ8MTXP01BTX5Y.45.37.D04.1.454.CMB.2.raw
  modified_base (330)..(330): a, c, t, g, unknown or other
  misc_feature (330)..(330): n is a, c, g, or t
  modified_base (397)..(397): a, c, t, g, unknown or other
  misc_feature (397)..(397): n is a, c, g, or t
  modified_base (433)..(433): a, c, t, g, unknown or other
  misc_feature (433)..(433): n is a, c, g, or t
  modified_base (444)..(444): a, c, t, g, unknown or other
  misc_feature (444)..(444): n is a, c, g, or t
  modified_base (476)..(476): a, c, t, g, unknown or other
  misc_feature (476)..(476): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgacccagtctccagactcctggctgtgtctcgtgggcgagacggccacatcaactgacaagtccagcagagttgtttagacagctacaaacaaataaagaactactagcttacggaccaagacaacgaaaaccaggtacacgtcctacctaagctgctactaatttacgngggacacgtaccgtaacccgggaacgtccccggggtaccccctacggaccgtattcgaggtcggcgnggcgggtcgtgggacagtacttcactctacaccaancgagcacgcgngacgagactagaagtgtgggtgtacttagttntcgctgacaagtactaaattacttagtacttaacttccgttcgtacgttccggaccgtaagaacgttaagttacgtaatacgtaacaacgtagttcgtcgttcgtaacg

SEQ ID NO: 348349 - DNA, 568 bp, Homo sapiens
  misc_feature: GZ8MTXP01B9J3S.45.37.D04.1.454.CMB.2.raw
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
  modified_base (338)..(338): a, c, t, g, unknown or other
  misc_feature (338)..(338): n is a, c, g, or t
  modified_base (359)..(359): a, c, t, g, unknown or other
  misc_feature (359)..(359): n is a, c, g, or t
tcagacgcgatcgacacgaccggtgctcgatttagtagcatactgttgggtttggggagagcatcacccagcaaccacatctgtcctctagagaatccccgtgagagctccgttcctcaccatggactggacctggaggatcctcttcttggtggcagcagccacaagagcccactcccaggtgcagctggtgcagtctggggctgaggtgaggaagccgtggggcctnagtgaaggtcncctgcaaggcttcnggctacaccttcaccggcgactatctccatggtgacgacaggcccctggacagggcttgagtggatggatggatcccaacctanaagtggtaggaacaacaactntagaccagagtaagtttcgagggtcagggtcacagtgaccgagggacacgtccatcaacggacacgacgggacctacgagtcggaacgcgtaggaggaccagtaccgaggaacctgtaacgtacgaacggaccaacgggtacctagttttaacgttagttggtaaggagtaaggtagttacgggtttacggtcggttaacgttttcggg

SEQ ID NO: 348350 - DNA, 686 bp, Homo sapiens
  misc_feature: GZ8MTXP01A0Y9S.45.37.D04.1.454.CMB.2.raw
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
tcagacgcgatcgacacgaccggtgctcgatttagtagcatactgttggggtttgggggcatcacccagcaaccacatctgtcctctagagaatcccctgagagctccgttcctcaccatggactggacctggaggatcctcttcttggtggcagcagccacaagagccccactcccaggtgcagctggtgcagtctggggctgaggtgaggagcgtggggctcagtgaggtctctgcaggctcgnggctacnctcgaccgcgactatctccacgtgggtgccgacgacggcccccgtggacgaagggcttggagtggagtgggatggactacgaaacccctaagaagtggtaggaccaacaaaaactatgacaaacgagtaaacgtttcgaaggggtctaacggggtcaaccgtagtacggaacccgaaacggggtacctaacccgggttaccaaacgttccgaacggaccaaccgttaacgaccccgttaacggaaagttcgggaaacgtccgtaggacgaccgaaggaaccgtggaaacctacgttaccgtaacggaaccgaaacccgttaccgggtaacccttagttttaaaccgttacgttgggttacgaccgggtaagggtacgtttaacgggtttaacccgggtgggttccggtttcggttttccgtttttaaccgggg

SEQ ID NO: 348351 - DNA, 806 bp, Homo sapiens
  misc_feature: GZ8MTXP01CQSCQ.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactcctggctgtgtctctgggcgagagggccacatcaactgacaagtccagccagagtgtttagacagctacaaacaataagaactactagcttaggtaccagacaagaaaccaggtacacgcctacctaagctgctactatttacgtgggactacgtccgtaacccggggaactcccgggggtacccccctacggaaccgtagtttaccgaaggttcgggacctaacgggtccgggggtttacgtacgggggaacctaacgggtacttttaccaaacccgttcctacccaaaccccgtaaattcccgaaaggcccaaaacggccccgaaaggacccggttaaagggacccgttaagggaaaacggtacgtttggggggttacgggttaaccgtttaaggggtttttaactttgggcccttacgggttaaacgtaaacgttaaacttaaaattttaaacgttttaaacttttaaaccgtttaaccccgttttaccccgtttaccccgggtttaacccggttttaccccggggtaaccccgggttaaacggggttaaaacccgttaaaagggttacggtaaacttaaacgtaaacccgtaaaacggtacgttacggttaacggttaaccgtaacg

SEQ ID NO: 348352 - DNA, 534 bp, Homo sapiens
  misc_feature: GZ8MTXP01DXR2B.45.37.D04.1.454.CMB.2.raw
  modified_base (227)..(227): a, c, t, g, unknown or other
  misc_feature (227)..(227): n is a, c, g, or t
  modified_base (363)..(363): a, c, t, g, unknown or other
  misc_feature (363)..(363): n is a, c, g, or t
  modified_base (420)..(420): a, c, t, g, unknown or other
  misc_feature (420)..(420): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
  modified_base (457)..(457): a, c, t, g, unknown or other
  misc_feature (457)..(457): n is a, c, g, or t
tcagacgcgatcgacacgaccggtgctcgatttagtagcatactgttgggtttgggggagaacatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggagcctgggcctnagtgaaggtctctgcaaggcttctggctacacctcaccggcgactagtctccacgtgggtgcgacacggcccctggacaagggcttgagtggatgggatggatccaaacccctaacaatgggtgacaaacaaactntgcaacagaagtttcgagggtcagggtcacagtgacagggaacacgtccatcagcanacgaccctanagtggagcagacgngaagacctggacntcaagtacgacgaccggcctatttattaacgttgacgcgagtgttacggttaccgttggtcgttggtttttaacccg

SEQ ID NO: 348353 - DNA, 518 bp, Homo sapiens
  misc_feature: GZ8MTXP01CB4LQ.45.37.D04.1.454.CMB.2.raw
  modified_base (226)..(226): a, c, t, g, unknown or other
  misc_feature (226)..(226): n is a, c, g, or t
  modified_base (341)..(341): a, c, t, g, unknown or other
  misc_feature (341)..(341): n is a, c, g, or t
  modified_base (362)..(362): a, c, t, g, unknown or other
  misc_feature (362)..(362): n is a, c, g, or t
  modified_base (433)..(433): a, c, t, g, unknown or other
  misc_feature (433)..(433): n is a, c, g, or t
  modified_base (489)..(489): a, c, t, g, unknown or other
  misc_feature (489)..(489): n is a, c, g, or t
  modified_base (502)..(502): a, c, t, g, unknown or other
  misc_feature (502)..(502): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtatggggctgaggtgaggaagcctggggcctnagtgaggtctctgcaaggcttctggctacacctcaccggcgactatctccacgtgggtgcgacacggcccctggacaagggcttgagtggatgggatggatcaaacccccctaanaatggtaggacaaacaaactntgacacagaagttcgagggcagggtcacatgaccagggacacgtccatcagcactagcctacagtgacgcngagcaaggacctgaccatcaagacgcacggcctatttattacgttgttgcgaggtnttcggttaccggnggtcgttggttttccg

SEQ ID NO: 348354 - DNA, 584 bp, Homo sapiens
  misc_feature: GZ8MTXP01CQEY8.45.37.D04.1.454.CMB.2.raw
  modified_base (347)..(347): a, c, t, g, unknown or other
  misc_feature (347)..(347): n is a, c, g, or t
  modified_base (370)..(370): a, c, t, g, unknown or other
  misc_feature (370)..(370): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacacctcaccggcgactatcctccacgtgggtgcgacacggcccctggacaagggctgagtggagtgggatggataccaaacccccctaanaagtgggtagacaaacgaaactntcgacacgagtaagtttcgagggacgagggtcaccgagtcgaccgagggacaccgtaccgatcgagcaacacgacctacagtgggaacgcgtagacgcgaagactagactactcgtaacgaccgaacgtaccggaccttaattttagttaccgttggttacgtcgggaaggttgttacgggtttaccgggttggtcgtttcgggtttttaaccg

SEQ ID NO: 348355 - DNA, 520 bp, Homo sapiens
  misc_feature: GZ8MTXP01DNW2J.45.37.D04.1.454.CMB.2.raw
  modified_base (358)..(358): a, c, t, g, unknown or other
  misc_feature (358)..(358): n is a, c, g, or t
  modified_base (427)..(427): a, c, t, g, unknown or other
  misc_feature (427)..(427): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaaggcttctggctacacctcaccggcgactaatctccactgggtgcgacaggcccctggacaagggcttgagtggatgggatggatcaaccccctacaatggtgcaaacaaactntgcaacagaagtttcagggcagggtcaccatgacagggacacgtcatcagcacagcctacatcggagcngagcaagccgtgaccatcctaagacacgacggcctaatttattacttgttagcgagggaattggttacccgggttggtcgttgggtttttccg

SEQ ID NO: 348356 - DNA, 590 bp, Homo sapiens
  misc_feature: GZ8MTXP01DL5CM.45.37.D04.1.454.CMB.2.raw
  modified_base (229)..(229): a, c, t, g, unknown or other
  misc_feature (229)..(229): n is a, c, g, or t
  modified_base (371)..(371): a, c, t, g, unknown or other
  misc_feature (371)..(371): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctnagtgaaggtctctgcaggcttctggctacacctcaccggcgactatcctccacgtgggtgcgacgacggcccctggacgaagggcttgaggtggagtgggatggactaccaaaccccctaacaagtggtgacaaacaaactntgacaacgagtaagttcgagggcagggtcacagtcgaccgaggacacgtacatcagcacacgcctacagtggacgcgtagagcgaagacgtgaactactcgtaagaaccgacgtaaccggaccttaagttttaacgttaacgttggttacggtaaccgggtaaggtaacgtttacggggtttacccgggttgggttccgttttcgggtttttaacccgg

SEQ ID NO: 348357 - DNA, 570 bp, Homo sapiens
  misc_feature: GZ8MTXP01AU1L1.45.37.D04.1.454.CMB.2.raw
  modified_base (379)..(379): a, c, t, g, unknown or other
  misc_feature (379)..(379): n is a, c, g, or t
  modified_base (498)..(498): a, c, t, g, unknown or other
  misc_feature (498)..(498): n is a, c, g, or t
  modified_base (556)..(556): a, c, t, g, unknown or other
  misc_feature (556)..(556): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctaccaaacaataagaactactagctggtaccagacaagaaaccaggtcagccctacctaagctgctctaatttacgcggcacgtaccgtacccgggaacgtcccggggtccccctagaccgtattcgagtcggacgnggtcgggtcgtacgggacagtacttcgacttcctacacctatcgagcacgcctgacgtaggctaggaagtcgtggggtagacttaggtttatggtcctgtacagtataattattaattntaacttccgttaccgtcttcccggacgtacggaaccgttagttgaactataacgaaancgttagtcgctccg

SEQ ID NO: 348358 - DNA, 782 bp, Homo sapiens
  misc_feature: GZ8MTXP01A6V87.45.37.D04.1.454.CMB.2.raw
  modified_base (227)..(227): a, c, t, g, unknown or other
  misc_feature (227)..(227): n is a, c, g, or t
  modified_base (639)..(639): a, c, t, g, unknown or other
  misc_feature (639)..(639): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctnagtgaaggtctcctgcaggcttctggctacaccttcaccgcgactatctccactggtgcgacgacggccccgtcggtacgaacgggcgttgtaggtgggtagtagggtagtaggacgtacccaaacccgtaaacaaagtacgggtcggtaaccgaaacctaaaccgtaaagttacggacccgaaaccgtaagggtaaaacgggtttttacgtaacggggggacccgtaacgggggttacccgtaacccgaacggttacggaaccccggtaaacgggggaacccgtaaccgggttaccccgaaacttaccgaacgggacctaaacccgaacgggggtaccccttaaacccgaagttacggggtaaacggcccgttaggacgggtaaccgaacggtaaccgttacggtaaaccnccgttaacggttaccggaaacccggacccgttaaacccgggtacccgttaatttttaacgtttccgttaggtcggtaccgggtaagggttaacggtttcggggttttaaccccgggttggggttaaccggtttttcccggggg

SEQ ID NO: 348359 - DNA, 599 bp, Homo sapiens
  misc_feature: GZ8MTXP01CYW78.45.37.D04.1.454.CMB.2.raw
  modified_base (367)..(367): a, c, t, g, unknown or other
  misc_feature (367)..(367): n is a, c, g, or t
  modified_base (431)..(431): a, c, t, g, unknown or other
  misc_feature (431)..(431): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttctggctacacctcaccggcgactatctccacgtgggtgcgacacggcccctggacagggcttgagtggatgggatggatcaaaccccctaacaagtggtaggacaaaacgaaactntgacaacgagtaagtttcgagggtcagggtcaaccgagtcgaaccgaggggacaccggtccaancgacgacacgacgacgtaacgagtaggacgcgtagacgacgtaacgactagactacgtacgtaacggaaccgacgtaccgttacctttaaagtttacgttacgttgttacggtaacggtaggttaacgtttacgggtttaccggttcggtttccgtttcggttttccg

SEQ ID NO: 348360 - DNA, 663 bp, Homo sapiens
  misc_feature: GZ8MTXP01AOFXM.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcgagtgaaggtctcctgcaaggcttctggctacaccctcgaccggcgactatcctccacgtgggtcgcgacgacggcccccgtgggaccgaaggggtcttggaggtggagtgggatggataccaaaccccctaacgaagtgggtaggaccaaaacaaactgtcgacaactaaggtaagtttccgaaggggtaccgacggggttaccaaccgtagtacggaacccgaagggggaccaaccggttaccaacgtaccgaacgaccaacgacgaccctacaagtcgggaacgtcgtaggagacaacggactcggaactacgtcgtaacgaaccggacgtaaccggttacccttaaagttttaacgttaccgttgggttacggaacggtaaggtaacgtttcgggtttaccggggttcggttccgtttcgggttttttcccgg

SEQ ID NO: 348361 - DNA, 624 bp, Homo sapiens
  misc_feature: GZ8MTXP01CRWIP.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaggctctggctacacctcaccggcgactatcctccacgtgggtgcgacgacggcccctggacaagggcttgaggtggagtgggatggatacaaacccccctaacagtgggtacggacaaacgtaaaactgtacgacaacgaaggtaagtttcgaaggggcaggggtcaaccgatcgaaccgaggacacgtccatcagacacgacgacctacgagtggaacgctaggacgacgaacgactacggactacgttcgtaacgaaccggaaaccgtaccgggttaccttaaattttacgtttaaccgttgggttacggaaccggtagggttaacgtttcgggtttaacccgggggttggttaaccgtttcgggttttttaacccgg

SEQ ID NO: 348362 - DNA, 579 bp, Homo sapiens
  misc_feature: GZ8MTXP01CDZOJ.45.37.D04.1.454.CMB.2.raw
  modified_base (225)..(225): a, c, t, g, unknown or other
  misc_feature (225)..(225): n is a, c, g, or t
  modified_base (359)..(359): a, c, t, g, unknown or other
  misc_feature (359)..(359): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtgggcctnagtgaggtctctgcagctctggctacacctcaccggcgactatctccacgtgggtgcgacacggcccctggacaagggcttgagtggagtgggatggatccaaaccccctaacaatgggtagacaaacaaactntgacacgagtaagttcagggcagggtcaccatcgaccaggacacgtcatcagcacgacgacctaacgagtggacgctagacgcaacggactacgactactctaacggaacggttacgaccgggacctaacttttacgttaaccgttggttacggaaccgggtaaggtaacggtttacggtttaccggggttcgggttccgtttcggggttttttccccgg

SEQ ID NO: 348363 - DNA, 601 bp, Homo sapiens
  misc_feature: GZ8MTXP01AVGLP.45.37.D04.1.454.CMB.2.raw
  modified_base (444)..(444): a, c, t, g, unknown or other
  misc_feature (444)..(444): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacacctcaccggcgactatctccacgtgggtgcgacgacggccccgtggacgaagggcttgagtggagtgggatggatccaaaccccctaacaagtggtacgacaaaacgaaactgtgacaacgagtaagtttcgagggcgagggtcaccgagtcgaaccgagggacacgtcatcagcacagccgtanagtggacgcgtagacgacaaggactacgaactacgtcgtaacgaaccgacgtaccggacccttaaagttttaacgttacgttcgttacgggtaacggtaggttaacgtttacgggtttaccgggttcgggttccgttttaacgggttttttccccgg

SEQ ID NO: 348364 - DNA, 701 bp, Homo sapiens
  misc_feature: GZ8MTXP01AKBXV.45.37.D04.1.454.CMB.2.raw
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccacgtgggtgcgacacggccccctggacaagggcttgagtggagtggggatggatacaacctaacaagtggtggacaacgaaaaactatgacaaacgtaaggtaacgtttccgaggggtacgaacggggttaccaacccgaagttacgggaaaccccggaagggggaacccaacccgggttacccaacttaccgaacgacccgtaaccgaacggtaccccttaacggaagttacgggggaacgcccgttagggacggacgaacggtaaccgtagggaaaccctacgtttccgtacgggaacccggaaccgttacccggggtaaccccttaaagttttaaacgttaaccgttgggttacggaccggtaagggtacgttcggtttacccgggtggttccgtttaacgggttttccgtttttaacggg

SEQ ID NO: 348365 - DNA, 557 bp, Homo sapiens
  misc_feature: GZ8MTXP01D3F3E.45.37.D04.1.454.CMB.2.raw
  modified_base (435)..(435): a, c, t, g, unknown or other
  misc_feature (435)..(435): n is a, c, g, or t
  modified_base (460)..(460): a, c, t, g, unknown or other
  misc_feature (460)..(460): n is a, c, g, or t
  modified_base (462)..(462): a, c, t, g, unknown or other
  misc_feature (462)..(462): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagtgtttagacagctaccaaacaataaagaactactagcttaggtaccagcaagaaaccaggtcagcctctaagctgctctatttacgtggctacgtcctaccggggaactcccgggggtccccctggaccgtattccagtcggcgaaggcgggtctgggacagtacttcactctcacctgcagcacgcctgacaggctagaagtntgggtggactagtttatgcctgtananataatattattattaacttccttccgtaccgttccgtccgtacggttacgttaacgttagtaagtataacgtaacgtacgttacgtcgttcgtcg

SEQ ID NO: 348366 - DNA, 603 bp, Homo sapiens
  misc_feature: GZ8MTXP01CNNWL.45.37.D04.1.454.CMB.2.raw
  modified_base (226)..(226): a, c, t, g, unknown or other
  misc_feature (226)..(226): n is a, c, g, or t
  modified_base (368)..(368): a, c, t, g, unknown or other
  misc_feature (368)..(368): n is a, c, g, or t
  modified_base (450)..(450): a, c, t, g, unknown or other
  misc_feature (450)..(450): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtggggcctnagtgaaggtctcctgcaggcttctggctacacctcaccggcgactatctccacgtgggtgcgacacggcccctggacaagggcttggagtggagtgggatggataccaaacccccctaagaagtggtcgacaaaacaaactntcgacaacgagtaacgtttcgagggtcacgggtcaaccgagtcgaccgagggacacggtaccatcacgcacgacgacctaanacgtagggaagcgtaggacgacgaacggactacgactacgtcgtaacggaacgaccgtaccggacccttaaagttttacttaccgttggttacggaacggtaggtcgtttacgggtttaccgggttggtaaccgttttcgggtttttaacccg

SEQ ID NO: 348367 - DNA, 571 bp, Homo sapiens
  misc_feature: GZ8MTXP01DEJUY.45.37.D04.1.454.CMB.2.raw
  modified_base (431)..(431): a, c, t, g, unknown or other
  misc_feature (431)..(431): n is a, c, g, or t
  modified_base (536)..(536): a, c, t, g, unknown or other
  misc_feature (536)..(536): n is a, c, g, or t
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagccccactcccaggtgcagctggtgcagtcgtggggctgaggtgaggaagcctggggcctcagtgaaggtctcctgcaaggcttctggctacacccttcaccggcgactatctccactgggtgcgacacggccccctggacaagggctgagtggagtgggatggatcaaaccctaacatggtgacacaaaaactatgacacaagtaagttcagggcagggtcacatagacagggacacgtcatcagcacagcctacgagtggaancgtgaagcaagacctggactatcgtcgaacgacgaccggtaccttaagttttaacttacgttagttcgttaccggaagggttagttaacgggtttttaaccgggngggttcgttttccgggttttcgttttttaaccggg

SEQ ID NO: 348368 - DNA, 561 bp, Homo sapiens
  misc_feature: GZ8MTXP01B39RQ.45.37.D04.1.454.CMB.2.raw
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacacctcaccggcgactatctccactgggtgcgacacggcccctggaccgaagggcttgagtggagtgggatggatcaaccccctaanatggtgcaaacaaactntgcacagaagtttcaggggcagggtcaccatcgaccgagggacacgtccatcagcacacgcctacagtgagctagacgcaggcctgactagtcgtaacggaacgacgaaccggttcctaattttaacgttaccgttggttcggtaacggagggtaagttcgggtttaccgggttgggtaaccgtttgggtttttaaccccg

SEQ ID NO: 348369 - DNA, 612 bp, Homo sapiens
  misc_feature: GZ8MTXP01AFIUQ.45.37.D04.1.454.CMB.2.raw
  modified_base (367)..(367): a, c, t, g, unknown or other
  misc_feature (367)..(367): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaaggtctcctgcaaggcttctggctacacctcaccggcgactatctccacgtgggtgcgacacggcccctggacaagggcttgagtggagtgggatggatacgaaccccctaacagtggtaggacaaacaaactntgacacgagtaagtttcgagggcgagggtcaccgatcgaccgaggacacgtcatcgagcacacgaccgtacagtggacgcgtgacgcgaacgacgtaggaactacgtcgtaacggaaccgaaccgtacccgggttacccttaaagttttaacgtttaacgttcggttacgggaaccggttaggggtaacgttttacgggtttacccggggttgggttcccgtttcggggtttttttaaccccggg

SEQ ID NO: 348370 - DNA, 561 bp, Homo sapiens
  misc_feature: GZ8MTXP01CPP2N.45.37.D04.1.454.CMB.2.raw
  modified_base (343)..(343): a, c, t, g, unknown or other
  misc_feature (343)..(343): n is a, c, g, or t
  modified_base (362)..(362): a, c, t, g, unknown or other
  misc_feature (362)..(362): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagccgtggggcctcagtgaaggtctcctgcaggcttctggctacacctcaccggcgactatctccacgtgggtgcgacacggccccctggacaagggcttgagtggatgggatggatcaaccccctaanagtggtggcaaacaaactntgacacgagtagtttcgagggcagggtcaccgagtcgaaccgaggggaacacgtccatcgacgcacacgcctacagtggagctgacgcaggactgacacttcgaagaccgacgaccggaccttaatttacttacgttgttggtccggaggttaacgttcgggttttaccgggttgggtccgtttggggtttttaacccg

SEQ ID NO: 348371 - DNA, 690 bp, Homo sapiens
  misc_feature: GZ8MTXP01D1UGY.45.37.D04.1.454.CMB.2.raw
  modified_base (254)..(254): a, c, t, g, unknown or other
  misc_feature (254)..(254): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagcctggggcctcagtgaaggtctcctgcaaggcttcnggctacaccttcaccggcgactatctccacgtggtgcgacacggccccctggaacaagggtcttggagtgggatgggatggactacccaaaccctaaagaagtgggtacggaacaaacgtaaactataggaccaacgaaggtaaacggtttacgaaggggacgtaaggggtaccaaaccgaagtacggaaacccgaacgggggaacctaaccggttcccaattaccgaacggaccaacgaacggggtaccctaaacgaagttacggggaagtccgtaggaacggaccaaggtaaccgtaggaacctaagttaacggttcggaaaccgaaccgaaaccggggtacccttaagttttaacttaccgttagggttcggaccgggtaagggtaacgtttacggggttttaacccgggttgggttccgttttttccggggg

SEQ ID NO: 348372 - DNA, 606 bp, Homo sapiens
  misc_feature: GZ8MTXP01D810I.45.37.D04.1.454.CMB.2.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (344)..(344): a, c, t, g, unknown or other
  misc_feature (344)..(344): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagacgcccactcccaggtgcagctggtgcagtcgtgggggctgaggtgaggagcgtggggctnagtgagtctctgcagctcgnggctacaccttcaccggcactatcctccacgtggtgccgacgcggcccctggacgaagggtcttggagtgggagtgggatggaactaccaaaccctaanagtggtacgacaaacgaaaaactagtcgactaacgaaggtaacgtttacgaggggtactacgggtacacgatacggacgacgggacacgtacatacgacgacacgagtccctaagagtagggatccgagacgacgaagtaccgtgaacctacgttcgacggaaacccgacgttaaccggtaccttaattttaacgtacgttgttcggacgtaaggtacggtttggtttacccgggtggttcgtttcggtttcgtttaacggg

SEQ ID NO: 348373 - DNA, 562 bp, Homo sapiens
  misc_feature: GZ8MTXP01BONTN.45.37.D04.1.454.CMB.2.raw
  modified_base (229)..(229): a, c, t, g, unknown or other
  misc_feature (229)..(229): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctnagtgaaggtctctgcaggctctggctacaccttcaccggcgactatctccacgtgggtgcgacaggcccctggacagggcttgagtggatgggatggactacccgaaaccctaacgaagtggtggacaacaactatcgacacagtaagtttcgagggtcaggggtcacgatcgaccgaagggacaccgtccagtcagacacacgggacctacgagtggagcgtgagcgagaccgtgaccatcgtggacccgacgaccggaccttaatttacgttcgttagttggaccggtaaggttaggttacggttttacgggtcggttcggtttttccggg

SEQ ID NO: 348374 - DNA, 591 bp, Homo sapiens
  misc_feature: GZ8MTXP01APA9E.45.37.D04.1.454.CMB.2.raw
  modified_base (345)..(345): a, c, t, g, unknown or other
  misc_feature (345)..(345): n is a, c, g, or t
  modified_base (366)..(366): a, c, t, g, unknown or other
  misc_feature (366)..(366): n is a, c, g, or t
  modified_base (425)..(425): a, c, t, g, unknown or other
  misc_feature (425)..(425): n is a, c, g, or t
  modified_base (436)..(436): a, c, t, g, unknown or other
  misc_feature (436)..(436): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagctggggcctcagtgaaggtctcctgcaaggcttctggctacacctcacggcgactatctccacgtgggtgcgacgacggcccctggacaagggcttggagtggatggggatggactaccgaaaccccctaanagtggtcggacaaacaaactngaccaacgagtaagttcgagggcagggtcaccgagtcgaaccgaggacacgtcatcgancacacgcctanggtgacgcgtgacgcgaaggactaggactacgtcgtaacggaaccgacgtaccgggttcccttaaagtttaacgttacgttggttcgggtaaccggtaaggtaacgttttcgggtttaccgggttcgggttccgttttcggggtttttaacccgg

SEQ ID NO: 348375 - DNA, 621 bp, Homo sapiens
  misc_feature: GZ8MTXP01BEC0E.45.37.D04.1.454.CMB.2.raw
  modified_base (379)..(379): a, c, t, g, unknown or other
  misc_feature (379)..(379): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtggggcctcagtgaaggtctcctgcaaggcttctggctacacctcaccggcgactatctcacgtgggtgcgacacggcccctggacgaagggcttgagtggagtggggatgggactaccgaaaccccctaactaagtcgggtggacctaaaacaaaacgtntacgacgaaccgtaaggtaacgtttcgaggggtacgacggggtacaccgagtcgaaccgagggaccacgtacacgtcacgacacgacgactacgacgtggagtccgagacgacgacgactcgaactagttaccgcgaacgaccgaacgggttccctaaagttttacgttaccgttggttcggaacggtaggtaacgtttacgggtttaccggttggttccggttttcggtttttaacccggg

SEQ ID NO: 348376 - DNA, 719 bp, Homo sapiens
  misc_feature: GZ8MTXP01CGGQ1.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaaggtctcctgcaaggcttctggctacacctcgaccggcgactatctccacgtgggtgcgacgacggccccgtggaaccaagggccttaggagttggagttgggatggactaccgaaacccccctaagaagtcgggtaggaccaaaacgtaaactgtcggaccaaacgtaaggtaaacggtttcgaacgggggtaccgtaggggttacccaaccggtaacgttacgggaacccgaagggggaaccctaaccgggttaccccaagtacccgaacgaccaaccgacggtaaccccttagaacggtacgggaacgtcgtacggaacgtacgaacggtacgtacggaaccgtactaccgtaacggaaccgttaacgtacccgggttacctttaaagttttacgtttaaccgttggttacggtaaccggtagggtttaacgtttcgggtttaccccgggttgggttcccgttttcggggttttttccccgg

SEQ ID NO: 348377 - DNA, 584 bp, Homo sapiens
  misc_feature: GZ8MTXP01D1JTB.45.37.D04.1.454.CMB.2.raw
  modified_base (378)..(378): a, c, t, g, unknown or other
  misc_feature (378)..(378): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctggaggtgaggaagccgtggggcctcagtgaaggtctcctgcaagggcttctggctacaccctcaccggcgactatctccacgtgggtgcgacgacggcccctggaacgaagggtcttggaggtggagtgggatggatccgaaaccccctaacaaagtggtgacaaacaaacttngacaacgaagtaagtttcagggcagggtcaccgatgaccagggacacgtccatcgacgcaacgacgacctaacacgtggaacgcgagacgacgaacgactgaactctcgaacgaacgacaccggttaccttagttttacttacgttggttgtaacggagggtaacgtttcgggttaccgggttcggttcgtttcgggtttttccgg

SEQ ID NO: 348378 - DNA, 597 bp, Homo sapiens
  misc_feature: GZ8MTXP01DGR1L.45.37.D04.1.454.CMB.2.raw
  modified_base (366)..(366): a, c, t, g, unknown or other
  misc_feature (366)..(366): n is a, c, g, or t
  modified_base (578)..(578): a, c, t, g, unknown or other
  misc_feature (578)..(578): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggctcagtgaaggtctcctgcaaggcttctggctacacctcacggcgactatctccactgggtgcgacaggccccctggacaagggcttgagtggagtgggatggatccaaaccccctaacaaagtgggtaggacaaaacaaactntgacaacaagtaagtttcgaggggactaggggtaccaaccgagtacggaacccgaagggggaaccaccggtaccaactaccgaacggccaacctacggaccctaaccgaagttgggaacgccgttaggagaccgaaggactcggaacctatcgtaacgaacgacgacggacctaagtttaccagttgacgcgaggtaacttgggtttaccgnggtcgtttggttttaaccg

SEQ ID NO: 348379 - DNA, 542 bp, Homo sapiens
  misc_feature: GZ8MTXP01B1D0W.45.37.D04.1.454.CMB.2.raw
  modified_base (360)..(360): a, c, t, g, unknown or other
  misc_feature (360)..(360): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacacctcaccggcgactatctccacgtgggtgcgacacggcccctggacaagggcttgagtggatgggatggatccaaccccctaacaatggtgcaaacaaactntgcacagtaagtttcgagggcagggtcaccgatgaccgagggacacgtccatcagcacacgcctacagtggacgctgagcagacctgacactcaacgaacgacgacggcctaattttattaccgttggttcgcggtaggtaacgtttggtttacccgggttggtccgtttgggtttttcccg

SEQ ID NO: 348380 - DNA, 553 bp, Homo sapiens
  misc_feature: GZ8MTXP01BMP56.45.37.D04.1.454.CMB.2.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (340)..(340): a, c, t, g, unknown or other
  misc_feature (340)..(340): n is a, c, g, or t
  modified_base (469)..(469): a, c, t, g, unknown or other
  misc_feature (469)..(469): n is a, c, g, or t
  modified_base (504)..(504): a, c, t, g, unknown or other
  misc_feature (504)..(504): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtgggcctnagtgagtctctgcagcttcnggctacacctcaccggcgactatcctccacgtgggtcgcgacacggcccctggacaagggcttggagtggatgggatggatccaaaccccctaanaagtgggtggacaaacaaactgtgacacgaagtaacgtttcgaggggcaggggtcaacccgatggaacccgagggaccacggtcccatcagcacacgcctacagtggagctgacgcgaagactggactncgtaagacgacaccggttacctatttaacttacgngttacgcggaggtgttcggtttacgggttggtccgtttgggttttcccg

SEQ ID NO: 348381 - DNA, 612 bp, Homo sapiens
  misc_feature: GZ8MTXP01D5IB7.45.37.D04.1.454.CMB.2.raw
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctgggcctnagtgaggtctcctgcaggcttcnggctacaccttcaccggcgactatcctccacgtggtgcgacgacggccccctggaacaaggggtctttggaggtggagtgggatggactacccaaccctaacaagtggtaggaccaacaacgttgtacgaccacgtaaggtaacggtttacgacggggctacggggtaccaaccgagtacgaacccgaaggggaccaccggtaccatacgacgacaacacgtacccgggtacaagtggaagccgtaggagaccgagacgtagaccagtctagaccggacttacggtaccttaattttacgttacgttgtaacggtacggtaacgggtagttcggtttacccggggtggttccgtttttccggg

SEQ ID NO: 348382 - DNA, 568 bp, Homo sapiens
  misc_feature: GZ8MTXP01AISLX.45.37.D04.1.454.CMB.2.raw
  modified_base (371)..(371): a, c, t, g, unknown or other
  misc_feature (371)..(371): n is a, c, g, or t
  modified_base (430)..(430): a, c, t, g, unknown or other
  misc_feature (430)..(430): n is a, c, g, or t
  modified_base (446)..(446): a, c, t, g, unknown or other
  misc_feature (446)..(446): n is a, c, g, or t
  modified_base (469)..(469): a, c, t, g, unknown or other
  misc_feature (469)..(469): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctacaacaataagaactactagcttggtaccagcaagaaaccaggtcagccctactaagctgctctatttactgggcatccgtaacccgggaagtcccggggtccccctggaccgtattccgagtggcgnggcgggtctgggacaggtactttcactctcaccatcagcacgcctgcaggctagaaagngtggggtgctagtttntgctgcagactaattattacttntaacttcccgttaccgtacgtttccggcccgttaaggggaaccttaaaaggttcggtaattacgtaaccgaaaacggtacgttggtaacggctaaccgg

SEQ ID NO: 348383 - DNA, 556 bp, Homo sapiens
  misc_feature: GZ8MTXP01AMCRF.45.37.D04.1.454.CMB.2.raw
  modified_base (350)..(350): a, c, t, g, unknown or other
  misc_feature (350)..(350): n is a, c, g, or t
  modified_base (461)..(461): a, c, t, g, unknown or other
  misc_feature (461)..(461): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacacctcaccggcgactatcctccacgtgggtgcgacgacggcccctggacgaagggcttgaggtggagtgggatggatacaaacccccctaanagtcggtggacaaaacaaactaatgacaacgagtaagttcgagggcgagggtcaccgagtcgacgagggacacgtccatacacgacacgacgacctaacgagtcggagtcngacgcgagactgacatctaagacgacgacgactatttattacgttgttacgcggagtaagttcggtttacggttcggtcgtttcggttttaaccg

SEQ ID NO: 348384 - DNA, 545 bp, Homo sapiens
  misc_feature: GZ8MTXP01BMQDU.45.37.D04.1.454.CMB.2.raw
  modified_base (347)..(347): a, c, t, g, unknown or other
  misc_feature (347)..(347): n is a, c, g, or t
  modified_base (367)..(367): a, c, t, g, unknown or other
  misc_feature (367)..(367): n is a, c, g, or t
  modified_base (526)..(526): a, c, t, g, unknown or other
  misc_feature (526)..(526): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagcctggggcctcagtgaaggtctcctgcaaggcttctggctacacctcgaccggcgactatcctccacgtggggtgcgacacggcccctggacaagggcttggagtggagtgggatggatcaaaccccctanaatggtggcaaacgaaactntgacacagtaagtttcgagggcagggtcaccagtgaccagggacacgtcatcacgcacacgacctacagtggacgcgtgagcaagcctggactagtctgaaccgacgaccggcctaagtttacttacgttgttcgcggtaggtcttgggtttacccggngggtcgttggtttttcccg

SEQ ID NO: 348385 - DNA, 540 bp, Homo sapiens
  misc_feature: GZ8MTXP01EE05Q.45.37.D04.1.454.CMB.2.raw
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
  modified_base (414)..(414): a, c, t, g, unknown or other
  misc_feature (414)..(414): n is a, c, g, or t
  modified_base (449)..(449): a, c, t, g, unknown or other
  misc_feature (449)..(449): n is a, c, g, or t
  modified_base (457)..(457): a, c, t, g, unknown or other
  misc_feature (457)..(457): n is a, c, g, or t
tcagacgcgatcgacacgaccggtgctcgattttagtagcatactgttggggtttgggggcatcacccagcaaccacatctgtcctctagagaatccccctgagagctccgttcctcaccatggactggacctggaggatcctcttcttggtggcagcagccacaagagccccactcccaggtgcagctggtgcagtctggggctgaggtgaggaagccgtgggggcctcagtgaaggtctcctgcaaggcttctggctacaccttcaccggcgactatctccacgtgggtncgacncggcccctggacaagggcttgagtggatgggatggatacaacctaacatggtgacaacaaaactatgcaacagtaacgtttcgagggcagggtcacagcgacaggacacgtcatcancgacagcctagagtgagctgagcagactgacatcngaacgacncggtaccttagtttacttacgttgttcgacgtaaggtacgttggtttaccggtggttcgtttaacggtttccgttttaacggg

SEQ ID NO: 348386 - DNA, 588 bp, Homo sapiens
  misc_feature: GZ8MTXP01C3AFF.45.37.D04.1.454.CMB.2.raw
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagccccactccccaggtgcagctggtgcagtctggggctgaggtgaggaagccgtgggggcctcagtgaaggtctcctgcaaggcttctggctacgaccttcaccggcgactatcctccactgggtgcgacaggccccctggacaagggctgagtgaagtgggatggatcaaaccctaacagtggtggacacaaaaacttatgacacgaagtaacgtttacgaggggcgagggtcacgagtacgaccgagggacaacgtcatacagacacacgcctaacgagtgggagcgtagagacgagactggaacactcgtgaaccgacgaccgggtaccttaattttaacgtacgttggttcggacggtaagggtagtttcgggttttaccgggtggttcgtttaacgggttttccgtttttaacgggg

SEQ ID NO: 348387 - DNA, 619 bp, Homo sapiens
  misc_feature: GZ8MTXP01C43QQ.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacacctcaccggcgactatcctccacgtgggtgcgacacggcccctggacgaagggcttggagtggagtgggatggatcaaacccccgtaacaagtggtaggacaaaacaaactgtgacaacgagtaagtttcgagggacgagggtcaaccgtagacgaaccgaagggaccacgtaccatacagaccaacgacgacccttaacgaaggtacggacgtcgagacgacgaacgtacgtacgactacgtacgtaacgaaccgaccgtaccgttaactttaaacgtttaacgttacgttcggttacggtaacggtaggttaacgtttacggggtttaccgggttcggttccggttttcggttttaaccg

SEQ ID NO: 348388 - DNA, 541 bp, Homo sapiens
  misc_feature: GZ8MTXP01A69BY.45.37.D04.1.454.CMB.2.raw
  modified_base (345)..(345): a, c, t, g, unknown or other
  misc_feature (345)..(345): n is a, c, g, or t
  modified_base (365)..(365): a, c, t, g, unknown or other
  misc_feature (365)..(365): n is a, c, g, or t
  modified_base (501)..(501): a, c, t, g, unknown or other
  misc_feature (501)..(501): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcagtgaaggtctcctgcaaggcttctggctacacctcaccggcgactatctccacgtgggtgcgacacggcccctggacaagggcttgagtggagtgggatggatccgaaaccccctaanaagtgggtgcaaacaaactntgacacagtacgtttcgagggcagggtcacgatcgacgagggacacgtcatcagcacacgcctacagtggagctgagcaagactagacctatcaacgaacgacgacggcctaagtttacttacgttgttcgaacgnggtaacgttcggttacggttcggtcgtttcggttttcccg

SEQ ID NO: 348389 - DNA, 631 bp, Homo sapiens
  misc_feature: GZ8MTXP01AZ7WL.45.37.D04.1.454.CMB.2.raw
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctnagtgaaggtctctgcaggcttcgnggctacacctcgaccggcgactatcctccacgtgggtgccgacacggccccgtaggacgaagggcttgaggtggagtgggatgggactaccgaaacccccctaagaagttgggtaggaccaaaactaaactgtgacaaccgaaggtaacggtttcgaggggcgacgggtcaaccgagtcgaaccgagggaccaccgtcatcagcacacgcctaacgagtaggacgtccgtaggacgacgagacgtacggactacttcgaacggaaccgaccgacccgggttaccgtaaattttacgttaaccgttggttacggtaacggtagggttaacgtttacggggtttaccccgggttgggttcccgtttttcgggtttttcccggg

SEQ ID NO: 348390 - DNA, 602 bp, Homo sapiens
  misc_feature: GZ8MTXP01D5P1X.45.37.D04.1.454.CMB.2.raw
  modified_base (467)..(467): a, c, t, g, unknown or other
  misc_feature (467)..(467): n is a, c, g, or t
  modified_base (554)..(554): a, c, t, g, unknown or other
  misc_feature (554)..(554): n is a, c, g, or t
  modified_base (579)..(579): a, c, t, g, unknown or other
  misc_feature (579)..(579): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggagatcctcttcttggtggcagcagccacaagagcccactcccaggtgcagctggtgcagtctggggctggaggtgaggagccgtggggcctgagtgaaggtctcctgcaaggcttctggctacgacctcaccggcgactatcctccacgtgggtgcgacgaggccccctggaacgaagggcttggaggttggagtgggatgggactccaaaccccctaacaaagtggtaggacaaaacaaactgtgacaacaagtaagtttccgaaggggtcagggtcaaccagtacgaaccgaaggggaacaccgtaccaatcagacaacacgacccctaanacgttaggaacgtcgaggacgctaaggacctaggaactactcgtaagaaccgacaccggaccttaattttacttaacgttgttacgnggtaggtaacgttcgtttaccgggngttcgttcggttttttaacccgg

SEQ ID NO: 348391 - DNA, 629 bp, Homo sapiens
  misc_feature: GZ8MTXP01AS0AL.45.37.D04.1.454.CMB.2.raw
  modified_base (289)..(289): a, c, t, g, unknown or other
  misc_feature (289)..(289): n is a, c, g, or t
  modified_base (462)..(462): a, c, t, g, unknown or other
  misc_feature (462)..(462): n is a, c, g, or t
tcagacgcgatcgacacgaccggtgctcgatttagtagcatactgttgggtttgggggcatcacccagcaaccatatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaggtctcctgcaaggcttctggctacaccttcgaccggcgactatctccacgtgggtncgacgacggccccctggacaagggcttggagtggagtgggatggactcaaaccctaacaagtggtaggcaaacaaaacgtatcgacaacgagtaacgtttcgaggggtcagggtacacctagtcgaccgagggacaccgtacatcgacgacacacgaccctacgagtgggacncgtaggacgacgacgaactcggaactacgtcgtcggaaacccgtacgaccgggtacctttaacgttttaattacccgttgggttacggttacggggtaacgggttaggtttccgggttttacccggggtggggttccgtttcggggtttttcccgttttaaccgggg

SEQ ID NO: 348392 - DNA, 511 bp, Homo sapiens
  misc_feature: GZ8MTXP01EPWHX.45.37.D04.1.454.CMB.2.raw
  modified_base (224)..(224): a, c, t, g, unknown or other
  misc_feature (224)..(224): n is a, c, g, or t
  modified_base (355)..(355): a, c, t, g, unknown or other
  misc_feature (355)..(355): n is a, c, g, or t
  modified_base (439)..(439): a, c, t, g, unknown or other
  misc_feature (439)..(439): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctgggcctnagtgaaggtctctgcaaggctctggctacacctcaccggcgactactccccactgggtgcgacacggcccctggacaagggcttgagtggattggatggatcaacctaacatggtgcacaaaactatgcanagaagtttcaggggcagggtcaccatcgacaggacacgtccatcagcaacacgcctacgatggagcgtagagcagactgactanctgaactacacggccttaattatacttgttgacgtggattggttacggtgttcgttcggtttcttttaacgg

SEQ ID NO: 348393 - DNA, 609 bp, Homo sapiens
  misc_feature: GZ8MTXP01EI24S.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcagtgaaggtctctgcagcttctggctacacctcaccggcgactatctccacgtgggtgcgacacggccccgtggacgaagggtcttggaggtggagtgggatggactaccaaacccccacaagtggtggacaaacgaaactgtgacagagtaagtttcgagggcagggtcacatcgacgaggaccacgtcatcacgcacacggacctacgagtggacgcgtcgagacgacgacgttagaactacgttcaacggaaccgaacgacccgggttacttaaacgttttaacgttaaccgttggttacgggtaaccggtaaggggttaacgtttacggggtttaacccggggttgggtttccggttttcgggtttttttccccggg

SEQ ID NO: 348394 - DNA, 665 bp, Homo sapiens
  misc_feature: GZ8MTXP01ETFJQ.45.37.D04.1.454.CMB.2.raw
  modified_base (375)..(375): a, c, t, g, unknown or other
  misc_feature (375)..(375): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcaaggcttctggctacacctcaccggcgactatctccactgggtgcgacaggcccctggacaagggcttgagtggagtgggactggatacaaaccccctaacaaagtgggtaggaccaaaactaaaactntacgacaaccgagtaaacggtttcgaggggacgaaggggttaccaaccgaagtacggaaccgaaggggaaccacggttaccaacacaacgacaacacggacccttaacaagtggaacgcgtgaacggaccaaagacgtacgaacacttcccgtaaggaaaccgaaccgaaccggggttaccctaaagtttttaaccttaacgttcggttaggaaccgggtaaacgggttaatttacgggggtttaaccccgggttagggttccggtttttcgggtttttttaaccccggg

SEQ ID NO: 348395 - DNA, 676 bp, Homo sapiens
  misc_feature: GZ8MTXP01BA1XA.45.37.D04.1.454.CMB.2.raw
  modified_base (348)..(348): a, c, t, g, unknown or other
  misc_feature (348)..(348): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctcctgcaaggcttctggctacacctcaccggcgactatctccacgtgggtgcgacgacggcccctggacaagggcttggagtggatgggatggatcaaacccccgtaanaagtgggtacggaccaaaacgaaaactgtcggacaacgtaggtaaaggtttccggaaggggtcgtacggggtacctaaccgaagtacggaaccggaaggggaacctaaccggttaccactacgacgaccaacgtaccggaccgttaacgaggtcggaacggtccgtacggacgacgaaacgtaccgtaggaacctaaagttccgtaacggaaccggaaccgaaccgggttacccttaaagttttaacgttaaccgttggttacgggaacgtagggttaactttacggggtttacgggttcgggttccgttttcgggtttttaacccgg

SEQ ID NO: 348396 - DNA, 544 bp, Homo sapiens
  misc_feature: GZ8MTXP01CQK4B.45.37.D04.1.454.CMB.2.raw
  modified_base (225)..(225): a, c, t, g, unknown or other
  misc_feature (225)..(225): n is a, c, g, or t
  modified_base (359)..(359): a, c, t, g, unknown or other
  misc_feature (359)..(359): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctnagtgaggtctctgcaggcttctggctacacctcaccggcgactatctccacgtgggtgcgacacggcccctggacaagggcttgagtggatgggatggatcaaaccccctaacaagtggtggacaaacaaactntgcaacgagtaagttcgagggcagggtcacatgaccagggacacgtccatcagcacagcctactagtggagctagagcaggacctgactatctaagacgacaccggcctaattttacttaacgttggttcgaacggtaggtaacgtttgggtttacccgggttggtccgtttgggttttaacccg

SEQ ID NO: 348397 - DNA, 525 bp, Homo sapiens
  misc_feature: GZ8MTXP01B8D2E.45.37.D04.1.454.CMB.2.raw
  modified_base (363)..(363): a, c, t, g, unknown or other
  misc_feature (363)..(363): n is a, c, g, or t
  modified_base (424)..(424): a, c, t, g, unknown or other
  misc_feature (424)..(424): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
  modified_base (462)..(462): a, c, t, g, unknown or other
  misc_feature (462)..(462): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccacatcaactgcaagtccagccagagtgtttagacagctcaaacaataagaactactagcttggtaccagacaagaaaccaggtcagcctactaagctgctctatttactggctatccgtacccgggaatccggggtccccctgaccgtattcagtcggcnggcgggtctgggacagtactttcactctacaccgatcagcacgcctgccaggctagaaagntcggggtgactagtttatgctgtcagntaatnttattntaactcttcgtacttcgccctggaaccttagttgaatagtaacaaacgtcttgtaagctaacg

SEQ ID NO: 348398 - DNA, 604 bp, Homo sapiens
  misc_feature: GZ8MTXP01AQJQM.45.37.D04.1.454.CMB.2.raw
  modified_base (364)..(364): a, c, t, g, unknown or other
  misc_feature (364)..(364): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacacctcaccggcgactatctccacgtgggtgcgacacggcccctggacaagggcttggagtggagtgggatggatcaaccccctaacaagtggtaggcaaacaaaactntagacaacgtagtaagtttcgaggggacaggggtacaaccgagtacgaaccgagggtacaccggtcaagtcagcaacgacgacctacagtgacgctgagaccagactggacatctggaaccgacgaccggttaccctaagttttaacttaccgttggttacggtaaccgggtaaggggttaagttttccggggtttaaccgggttcggggttcgttttccggggtttttttaaccccggg

SEQ ID NO: 348399 - DNA, 637 bp, Homo sapiens
  misc_feature: GZ8MTXP01EB035.45.37.D04.1.454.CMB.2.raw
  modified_base (225)..(225): a, c, t, g, unknown or other
  misc_feature (225)..(225): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagcgtgggcctnagtgaaggtctcctgcaagcttctggctacacctcaccggcgactactctccacgtgggtgcgacacggcccctgggaacaagggcttggagtggagtgggatggataccaaaccccctaacaagtggtcggaccaaaacgaaaactgtagacaacaagtaagtttcgagggcagggtacacagtcgaccgagggacacgtccatcacgcaacacgacctaacagtggaacgctaggaacgacgaaacgtaacgtcgaaccgtacttccgaacgggaaaccgaaccgtacccgggttaaccgtaaattttttaacgttaaccgttggttacgggaaccgggttaacgggtaagttttacggggtttaacccgggggttcgggttcccgtttttcggggttttttaaccccgg

SEQ ID NO: 348400 - DNA, 624 bp, Homo sapiens
  misc_feature: GZ8MTXP01BMN94.45.37.D04.1.454.CMB.2.raw
  modified_base (226)..(226): a, c, t, g, unknown or other
  misc_feature (226)..(226): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagcgtgggcctngtgaggtctcctgcaaggcttctggctacacctcaccggcgactatctccacgtgggtgccgacgccggccccgtggacgaagggtcttggagtggagtgggatggactaccgtaaacccccctaagaagtgggtacggacaaacgtaaactgtcgacaacgagtaacgtttacggagggacgtagggtccacgagtacggaccgagggtaaccacggtacagtacacgcaacgacgaccttaacgaggtacggacgtcgagacgacaacgtacgtacgactacgtccgtaacggaaccgaccgtaccggttaaccgttaatttacgttaccgttggttacgtaacggtaaggtcgttttacggtacgggttcggtcgtttcgggtttttaacccggg

SEQ ID NO: 348401 - DNA, 594 bp, Homo sapiens
  misc_feature: GZ8MTXP01EVGPX.45.37.D04.1.454.CMB.2.raw
  modified_base (295)..(295): a, c, t, g, unknown or other
  misc_feature (295)..(295): n is a, c, g, or t
  modified_base (352)..(352): a, c, t, g, unknown or other
  misc_feature (352)..(352): n is a, c, g, or t
  modified_base (462)..(462): a, c, t, g, unknown or other
  misc_feature (462)..(462): n is a, c, g, or t
  modified_base (496)..(496): a, c, t, g, unknown or other
  misc_feature (496)..(496): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcagtgaaggtctcctgcaggcttctggctacaccttcaccggcgactatctccacgtggtgcgacncggcccctggacgaagggcttggagtgggagtgggatggactacccaaaccctaaanaacgtggtacggaaccaaacaaccgtagtagacacgtaagtaacgtttacggacgggtacgaaggggttccaaccgagtacggaacccgtaggggaaccacggtaccacncacgacaccacggggtcctaacgagtacgggacncgtagacgacacggaacctgactagtcgtagaccgacgacgaccttatttacgttacgttggtgacggtgtagttcgggttacggtgttcgtttcggg

SEQ ID NO: 348402 - DNA, 548 bp, Homo sapiens
  misc_feature: GZ8MTXP01EK7KH.45.37.D04.1.454.CMB.2.raw
  modified_base (372)..(372): a, c, t, g, unknown or other
  misc_feature (372)..(372): n is a, c, g, or t
  modified_base (444)..(444): a, c, t, g, unknown or other
  misc_feature (444)..(444): n is a, c, g, or t
  modified_base (452)..(452): a, c, t, g, unknown or other
  misc_feature (452)..(452): n is a, c, g, or t
  modified_base (454)..(454): a, c, t, g, unknown or other
  misc_feature (454)..(454): n is a, c, g, or t
  modified_base (468)..(468): a, c, t, g, unknown or other
  misc_feature (468)..(468): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtcgtggggctggaggtgaggaagccgtggggcctcgagtgaaggtctcctgcaaggcttctggctacacctcaccggcgactatctccacgtgggtgcgacacggcccctggaccaagggcttggagtggagtgggatggatccaaaccccctaacaagtggtaggcaaacaaactntcgacacagtaagtttcgagggcagggtcaccatacgaccgagggaccacgtccagtcagcacacgacctanagtaggancngagcgagactgacntcaagacgacgacggcctaagtttaattacgttgttgcgaggtaacgttcggttaccgggttgtcgtttggttttaaccg

SEQ ID NO: 348403 - DNA, 595 bp, Homo sapiens
  misc_feature: GZ8MTXP01DS7C2.45.37.D04.1.454.CMB.2.raw
  modified_base (346)..(346): a, c, t, g, unknown or other
  misc_feature (346)..(346): n is a, c, g, or t
  modified_base (370)..(370): a, c, t, g, unknown or other
  misc_feature (370)..(370): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacacctcaccggcgactatctccacgtgggtgcgacgacggcccctggacgaagggcttggagtggatgggatggatccaaaccccctaanaaagtggtcggacaaacgaaactntgcaacagtaagtttcagggcagggtcacatgacgagggacacgtcatcagcaacacgacctaacagttagggacgcgtagagaccgaaggaccttaggacctatcgtaacgaacgaccgaacgggttcccttaaattttacttaaccgttggttacggtaaccggaaggttaacggtttacgggtttacccggggttcggttccgtttcgggttttttccccgg

SEQ ID NO: 348404 - DNA, 576 bp, Homo sapiens
  misc_feature: GZ8MTXP01D3NSZ.45.37.D04.1.454.CMB.2.raw
  modified_base (225)..(225): a, c, t, g, unknown or other
  misc_feature (225)..(225): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagccccactccccaggtgcagctggtgcagtctggggctgaggtgaggagcctggggcctnagtgagtctctgcaggctctggctacactcacggcgactatctccacgtgggtgcgacacggccccctggaccgaagggcttggagtggagtggggattggactacaaacccctaacagtgggtgaccaacaaaaactatgacaacgaagtaagtttcgaggggtcgagggtaccaccatacggaccgagggacaaccgtccagtcagcacacgacctacgagtggagcgtgaacgcgaagaactgactatctcggaaccgacgacggtaccttaatttagttaacgttggttgacggtaaggtagttcggtttaccgggtggttacgtttcggttttcccgttttaaggg

SEQ ID NO: 348405 - DNA, 552 bp, Homo sapiens
  misc_feature: GZ8MTXP01C24Y5.45.37.D04.1.454.CMB.2.raw
  modified_base (343)..(343): a, c, t, g, unknown or other
  misc_feature (343)..(343): n is a, c, g, or t
  modified_base (364)..(364): a, c, t, g, unknown or other
  misc_feature (364)..(364): n is a, c, g, or t
  modified_base (420)..(420): a, c, t, g, unknown or other
  misc_feature (420)..(420): n is a, c, g, or t
  modified_base (451)..(451): a, c, t, g, unknown or other
  misc_feature (451)..(451): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctggggcctcagtgaaggtctcctgcaaggcttctggctacacctcaccggcgactatctccactgggtgcgacacggcccctggacaagggctgagtggagtgggatggatccaaaccccctaanaagtggtggacaaacaaactntgcacagaacgttcaggggcagggtcaccatgaccagggacacgtccatcagcacncgcctaacagtggacgctgagcagactgacntctaacgaacgacgaccggaccttaattttacttacgttgttacggcggtaagggtaactttcgggttttaccgggttggtttccgttgggttttttcccg

SEQ ID NO: 348406 - DNA, 663 bp, Homo sapiens
  misc_feature: GZ8MTXP01ERC6B.45.37.D04.1.454.CMB.2.raw
  modified_base (228)..(228): a, c, t, g, unknown or other
  misc_feature (228)..(228): n is a, c, g, or t
  modified_base (250)..(250): a, c, t, g, unknown or other
  misc_feature (250)..(250): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtgggcctnagtgagtctctgcaggtctcgngctacacctcgaccggcactatcctccgacgtgggtgcgaccgacgggccccctagggaacgaaggggtctttggaggtgggagtggggatggactaccccaaaccctaaagaagtggggtacgaaaccaactaaactatacggaccaacgtaaaggttaaacggtttcggaacgggggtaccgtacggggtacccaaccgtagtacggaacccggaaacggggaaccaaccggtaccaataccgacgaccaacgacggtaccttaacgagtagggacgtccgtaggaacgaccaaggacctacgaactagtccgtaacggaaccgtaaccgaccggtaccttaagttttacgttcgttggttcggaggtaaggttacgttacgggtttaccgggtggtttcgttttaacggg

SEQ ID NO: 348407 - DNA, 584 bp, Homo sapiens
  misc_feature: GZ8MTXP01DZYIF.45.37.D04.1.454.CMB.2.raw
  modified_base (227)..(227): a, c, t, g, unknown or other
  misc_feature (227)..(227): n is a, c, g, or t
  modified_base (363)..(363): a, c, t, g, unknown or other
  misc_feature (363)..(363): n is a, c, g, or t
  modified_base (422)..(422): a, c, t, g, unknown or other
  misc_feature (422)..(422): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctnagtgaaggtctcctgcaaggcttctggctacacctcaccggcgactatctccacgtgggtgccgacacggcccctggacaagggcttgagtggatgggatggatcaaacccctaacaagtggtgacaaacaaactntgacaacagaagtttcgaggggcaggggtacaccagtcgaccgagggacacgtcccaancacgacacacgaccgtaacgagtacggacgcgacgagacgaacgactagactactcgaacgaaccgaccgtaccgttaccttaagtttaacgttacgttcggttacgaacggtaggtaacgtttcgggttaccgggttcggttccgtttcgggttttaaccg

SEQ ID NO: 348408 - DNA, 561 bp, Homo sapiens
  misc_feature: GZ8MTXP01BBZZM.45.37.D04.1.454.CMB.2.raw
  modified_base (454)..(454): a, c, t, g, unknown or other
  misc_feature (454)..(454): n is a, c, g, or t
  modified_base (476)..(476): a, c, t, g, unknown or other
  misc_feature (476)..(476): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtggggcctcagtgaggtctcctgcaggcttctggctacaccttcaccggcgactatctccacgtggggtgcgacgacggccccctgggacaaggggcttggaggtgggagtggggatggactacaaaccctaacgaagtggtagacaacaaaaactatgacaacgagtaagtttcgaggggcacgggtcaacgatacgaccgagggacacgtcatcagcacacgcctagacgtggacncgtagagcgagactgacatcgngaacgacgacggtccttagtttatacgttgttgacggtaagtagttcggtttacggtggttcgtttcggttttccgtttaacggg

SEQ ID NO: 348409 - DNA, 547 bp, Homo sapiens
  misc_feature: GZ8MTXP01AG158.45.37.D04.1.454.CMB.2.raw
  modified_base (465)..(465): a, c, t, g, unknown or other
  misc_feature (465)..(465): n is a, c, g, or t
  modified_base (506)..(506): a, c, t, g, unknown or other
  misc_feature (506)..(506): n is a, c, g, or t
  modified_base (522)..(522): a, c, t, g, unknown or other
  misc_feature (522)..(522): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagccccactcccaggtgcagctggtgcagtctgggggctgaggtgaggaagccgtggggcctcagtgaaggtctcctgcaaggcttctggctacaccttcgaccggcgactatctccacgtggggtgcgacacgggccccctgggacaaggggcttggagtggatggggatggatcaacctaacaagtggtgcacaaaactatgcaacagtaagtttcgaggggcagggtcaccagtcgacgagggacacgtcatcagcaacacgcctacgagtggagactgacgcaggactgactatcgngaaccgcacggccttatttattacttggttcgcggaaggtnttcgggttttaccggnggttcgtttcggttttccgtttggg

SEQ ID NO: 348410 - DNA, 604 bp, Homo sapiens
  misc_feature: GZ8MTXP01BIDTA.45.37.D04.1.454.CMB.2.raw
  modified_base (255)..(255): a, c, t, g, unknown or other
  misc_feature (255)..(255): n is a, c, g, or t
  modified_base (461)..(461): a, c, t, g, unknown or other
  misc_feature (461)..(461): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgactaaggtttcnggtctacaccttcgaccggcgactactcctccacgtgggtcgcgacgccggccccgtaggacaagggtcttggaggtggagtgggagtggaactaccaaacctaagaaagttgggtacggacaaactaaactatacgcaaacgaagtaacggtttcgaagggcgagggtccacagtacgacgagggacacgtacatcgacgaccanacgaccctagaggtaggagccgtaggacgcagactagactagtcgacgaacgaacgacgttccttaagtttactacgtggttcgcgttaggtgtttaccggttaacggtcgttcgtttcggtttaaccgttttcggaaccggg

SEQ ID NO: 348411 - DNA, 650 bp, Homo sapiens
  misc_feature: GZ8MTXP01D4H17.45.37.D04.1.454.CMB.2.raw
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagacgcccactcccaggtgcagctggtgcagtcgtggggctggaggtgaggaagccgtgggcctnagtgaggtctcctgcaggcttcngctacacctcaccggcgactactctccacgtggtgccgacgacggccccgtaggaccgaagggcttaggaggtggagtggatggactaccaaacccccgtaaacaagtggtagacaaaaccaaactgtacgacaacgaagtaacggttacgaggggacgacgggtaccaacgtagacggaaccgaacggggacctaaccgtacaactaccacgacaacctaacgacccttaaacgagtaggacggacacggacgaccgtaaagacgttacgaacctagtaccgtaacgggaaccgaaccgtaccggttaccttaaagttttaccgttaacgttggttacggaacggtaggttaacgttacgggtttccggggttgttcgtttcgggtttttaaccgg

SEQ ID NO: 348412 - DNA, 541 bp, Homo sapiens
  misc_feature: GZ8MTXP01EC9DL.45.37.D04.1.454.CMB.2.raw
  modified_base (461)..(461): a, c, t, g, unknown or other
  misc_feature (461)..(461): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggctctggctacacctcaccggcgactatctccacgtgggtgcgacacggcccctggacaagggcttgagtggagtgggatggataccaaaccccctaacaagtggtggacaaacaaactgtgacaacagtaagtttcgagggcagggtcacatcgacgagggacacgtcatcagacacacgacctaacagtggagctgacgcaaggctgacagtcngacgacgacggcctaattttacttacgttgttcgcgtaggtaagtttcggttaccgggttcgtcgtttcggttttaaccg

SEQ ID NO: 348413 - DNA, 610 bp, Homo sapiens
  misc_feature: GZ8MTXP01DHL9R.45.37.D04.1.454.CMB.2.raw
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgtttagacagctacaacaataagaactactagcttaggtaccagacaagaaaccaggtcaacgcctacctaagctgctactatttacgtggctagtccgtaacccgggaacgtcccggggtccccctggaccgtnttcgaggtcggcnggcgggtcgtgggacagtatttcactctacactatcacgcagtcctgcgaggctagaaagtcgtggggtaggtcttagtttatcgtcgtgtacaagtactaaattattaacttattaacgtttcccgttaccgtaccgtttccggaccccgttaggggttaaacccgttaaggttacggttaactaacgtaaccgtaaaacccggtattcgggtaacggccttaaccgg

SEQ ID NO: 348414 - DNA, 581 bp, Homo sapiens
  misc_feature: GZ8MTXP01DQJC8.45.37.D04.1.454.CMB.2.raw
  modified_base (371)..(371): a, c, t, g, unknown or other
  misc_feature (371)..(371): n is a, c, g, or t
  modified_base (404)..(404): a, c, t, g, unknown or other
  misc_feature (404)..(404): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagttgtttagacagctaccaaacaataagaactactagcttggtaccagacaagaaaccaggtacagcctacctaagctgctctatttacgtggcatccgtaacccgggaatcccggggtcccctgaccgtatcgaggtcgcgnggcgggtcgtagggacagtacttcactctcacntcagcagcctgccgaggctagaaagtcgtggggtacggtacttagttttatggaccttggtacaagactaaatttattaattattaacttcccttccgttaacgtttccggacccgttgggttaaacccaaggttacggaattaacgtaacgaaacgtacgttgtcggttctaaccg

SEQ ID NO: 348415 - DNA, 620 bp, Homo sapiens
  misc_feature: GZ8MTXP01DAP4K.45.37.D04.1.454.CMB.2.raw
  modified_base (338)..(338): a, c, t, g, unknown or other
  misc_feature (338)..(338): n is a, c, g, or t
  modified_base (478)..(478): a, c, t, g, unknown or other
  misc_feature (478)..(478): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgaccagtctccagactccctggctgtgtctcgtgggagaggagggccacatacaactgacaacgtccagccagtagttgtttagacagacctacaaacaataaacgtaactactagtcttacggaccagacaaagaaaccgagtaccacgccctacctaagctgactactatttacgnggacctacgtaccgtaacccggggtacgtcccggggtaccccctacggacgtattcgaggtcggacgaacgggcgggtacgtagggactagtacttcactctacactatcgagcgacgtcctgacgtaggctaagaagtntggggtcgtattagtttactgcgtgactaagattaattatttacttacttccgttccttacggttaccgtttccgggacccgttagggaacccttaaggttcgtaacgtacttaaccgaaacgtcgttacgtcggctaaccg

SEQ ID NO: 348416 - DNA, 561 bp, Homo sapiens
  misc_feature: GZ8MTXP01DBOI8.45.37.D04.1.454.CMB.2.raw
  modified_base (228)..(228): a, c, t, g, unknown or other
  misc_feature (228)..(228): n is a, c, g, or t
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (359)..(359): a, c, t, g, unknown or other
  misc_feature (359)..(359): n is a, c, g, or t
  modified_base (417)..(417): a, c, t, g, unknown or other
  misc_feature (417)..(417): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctgaggtgaggaagcctgggggcctnagtgaaggtctcctgcaaggcttctggctacacctcaccggcactatctccactgggtgcgacacggcccctggacaagggcttgagtggatggatggatcaaaccccctaaanagtgngacaaacaaatngacaacgtagtaagttcgagggacgaggtacaacagtacgaccgaaggactacgacanacagacacacgacgtacagtagagacgtgagacgacgacgtacgactactacgtaacgaacgacgaaccgaccgtaactttaacttacgttgttgtaacggtaggtaacgttacggtttacgggttacggttcgttcggtttcg

SEQ ID NO: 348417 - DNA, 657 bp, Homo sapiens
  misc_feature: GZ8MTXP01BUNE3.45.37.D04.1.454.CMB.2.raw
  modified_base (465)..(465): a, c, t, g, unknown or other
  misc_feature (465)..(465): n is a, c, g, or t
  modified_base (471)..(471): a, c, t, g, unknown or other
  misc_feature (471)..(471): n is a, c, g, or t
  modified_base (480)..(480): a, c, t, g, unknown or other
  misc_feature (480)..(480): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgaccagtctccagactcctggctgtgtctcgtgggcgaggacggccaacatacaaactgacaacgtccagccgagtagttgtttaacgacacgtacctaaccaaactaaagtaaacgtaacttactaacgtcttacggtaaccaagacgaaacgaaaccgagtacacgtaccctacgtaagctgctactacgtttacgcggtactacgttaccggaaccgggtacgtcccggggtaccctacggtactgttaccgaggtcggacgtggtccgggtagtcgggactagtacttcactccacaactnacacgnaccgtccgngacgaggtacaaggagttagtggggtacgtacgtttaagtttacggcgtcgttacgataagtaattaaatttacttaacttcgttaacccttccgttaccggtaccttccgggaaccgtaacggttaaacgttaggttactaactaacgtaacgtaacgtgttacggtcgaacgtcg

SEQ ID NO: 348418 - DNA, 568 bp, Homo sapiens
  misc_feature: GZ8MTXP01CV1I7.45.37.D04.1.454.CMB.2.raw
  modified_base (343)..(343): a, c, t, g, unknown or other
  misc_feature (343)..(343): n is a, c, g, or t
  modified_base (364)..(364): a, c, t, g, unknown or other
  misc_feature (364)..(364): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctctgcaggcttctggctacacctcaccggcgactatcctccacgtgggtgcgacgacggcccctggacgaagggcttgagtggatgggatggatcaaaccccctanaagtggtggacaaacaaactntgacacagtaagtttcgagggcagggtcaccgagtcgaccgagggacacgtccatcagcacacgcctacagtggacgcgtagagcgaacgactgacacgtctaaggaaccgacgaccggaccttaagttttacttacgttggttggtaaccggtaggtaacgtttcgggtttaccgggttggttccgtttcgggtttttcccgg

SEQ ID NO: 348419 - DNA, 593 bp, Homo sapiens
  misc_feature: GZ8MTXP01CK90O.45.37.D04.1.454.CMB.2.raw
  modified_base (353)..(353): a, c, t, g, unknown or other
  misc_feature (353)..(353): n is a, c, g, or t
  modified_base (377)..(377): a, c, t, g, unknown or other
  misc_feature (377)..(377): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctctgcaaggcttctggctaccacctcaccggcgactatcctccacgtgggtgccgacgacggccccctgggaccaagggcttggagtggagtgggatggataccaaaccccctanaagtggtacggacaaacgaaactntagacaacgagtaagttcgagggcagggtcacagtgaaccgagggacacgtcatcacgcacagcctacgaagtcgggacgcgtagacgacgaacgtactagaacctacgttacgtaagtacttacggaaccttaaccggtacctttaagtttacgttcgttacgtaaggtacggtaaggttacgttcgggtttaccggttggttccgttttaacgg

SEQ ID NO: 348420 - DNA, 557 bp, Homo sapiens
  misc_feature: GZ8MTXP01A5CUH.45.37.D04.1.454.CMB.2.raw
  modified_base (315)..(315): a, c, t, g, unknown or other
  misc_feature (315)..(315): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgtttagacagctaccaacaataagaactactagcttaggtaccagcaagaaaccaggtcagcctactaagctgctctatttacgnggcagtccgtacccgggatcccgggggtccccctggaccgtattcgagtcggcgaacggcgggtcgtcgggactagtactttcacttctacacctatcagcacgcctgccgagggctaggaatagtggggtacggtctaagtttactgcgttgcagtactaattattatataacttccttcgtactttcggaccgtaggaacccgttaaggttgaatactaacgaaacgattgtcgttctcg

SEQ ID NO: 348421 - DNA, 497 bp, Homo sapiens
  misc_feature: GZ8MTXP01DMVSU.45.37.D04.1.454.CMB.2.raw
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (267)..(268): a, c, t, g, unknown or other
  misc_feature (267)..(268): n is a, c, g, or t
  modified_base (283)..(283): a, c, t, g, unknown or other
  misc_feature (283)..(283): n is a, c, g, or t
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
  modified_base (382)..(382): a, c, t, g, unknown or other
  misc_feature (382)..(382): n is a, c, g, or t
  modified_base (453)..(453): a, c, t, g, unknown or other
  misc_feature (453)..(453): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagctgggctnagtgagtcnctgcagntngcanctcacgnatancncagtggtgcnngccctgacaggctgngtgatggatgatcaacccctaanatggtgaccaaacgaaactntgacaacgaggtaagtttcgagggtcgagggtcaccagtcgacgaggacacgtcancagcacacgcctacgatggagctagagcgaagcctagacatcaacgacgacctacggcctatttattacgngttacgcgtagtaagttcggttacggttgttcgttggttttccg

SEQ ID NO: 348422 - DNA, 770 bp, Homo sapiens
  misc_feature: GZ8MTXP01CNYQY.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctcctgcaggcttctggctacacctcaccggcgactatctccacgtgggtgcgacacggcccctggacaagggcttgagtggagtgggatggataccgaaaccccccttaacgaaagttggggtacggacctaaaaccgaaaacttaagtaggacctaacgtaaggtaaacggttttacgaagggggtcccgtaacgggggttaccaacccgtaaggttaccggaaacccgaacggggggaacctaaccgggttacccaacgttaccgaacggacccaaaccgaaccgggtaacccctttaacgaacggtttacggggaacgggtacccgtttgggaaacggtaccggaaacggtacccgttacgggaaaccccttaagttcccggttaacgggaaacccggaaaccggtaaccccggggttacccctttaaagtttttaacgttaacccgttgggttacggtaacggtaacgggttaagtttccgggttttaccgggttcgggttccgtttcggggtttttttaaccccggg

SEQ ID NO: 348423 - DNA, 552 bp, Homo sapiens
  misc_feature: GZ8MTXP01CUCCH.45.37.D04.1.454.CMB.2.raw
  modified_base (224)..(224): a, c, t, g, unknown or other
  misc_feature (224)..(224): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (275)..(275): a, c, t, g, unknown or other
  misc_feature (275)..(275): n is a, c, g, or t
  modified_base (331)..(331): a, c, t, g, unknown or other
  misc_feature (331)..(331): n is a, c, g, or t
  modified_base (351)..(351): a, c, t, g, unknown or other
  misc_feature (351)..(351): n is a, c, g, or t
  modified_base (454)..(454): a, c, t, g, unknown or other
  misc_feature (454)..(454): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctgggcctnagtgaggtcnctgcagctcngctacnctcacggcactatctccacgtggtncgacacggcccctggacaagggcttgagtggatggatggataccaaaccccctaanaagtggtgacaaacaaactntgacaacgagtaagttcgagggcagggtcacgatcgaccagggacacgtcatcacgcaacgacgacctaacagtacgggagctagacgccaaagctagactanctaaggaaccgacgtaccggccttaaagttttacttacgttgacggaaggtaacggttgttcgggtttacggttggttccgtttgggtttttaacccg

SEQ ID NO: 348424 - DNA, 581 bp, Homo sapiens
  misc_feature: GZ8MTXP01D5CAP.45.37.D04.1.454.CMB.2.raw
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (249)..(249): a, c, t, g, unknown or other
  misc_feature (249)..(249): n is a, c, g, or t
  modified_base (278)..(278): a, c, t, g, unknown or other
  misc_feature (278)..(278): n is a, c, g, or t
  modified_base (358)..(358): a, c, t, g, unknown or other
  misc_feature (358)..(358): n is a, c, g, or t
  modified_base (432)..(432): a, c, t, g, unknown or other
  misc_feature (432)..(432): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtgggctnagtgagtctcngcaggctcgnggctacaccttcgaccggcgaactatccnccacgtggggtgccgacgacggcccctggaaccgaagggtcttggaggtggagtggggatggactaccccaaaccctaanaagtggtagaacaaactaactatgacacgagtaagttcgagggcagggtcacagtcgacgagggacacgtacanacgagacacacggccttaacagtgggagcgtagacgacacgactcgactatccgtagaccgtaccgacgggtaccttaatttaccgttgttggttggacggtaagggttaacgtttcggggttaccgggttcggttcggtttttccggg

SEQ ID NO: 348425 - DNA, 546 bp, Homo sapiens
  misc_feature: GZ8MTXP01DLQSG.45.37.D04.1.454.CMB.2.raw
  modified_base (226)..(226): a, c, t, g, unknown or other
  misc_feature (226)..(226): n is a, c, g, or t
  modified_base (364)..(364): a, c, t, g, unknown or other
  misc_feature (364)..(364): n is a, c, g, or t
  modified_base (437)..(437): a, c, t, g, unknown or other
  misc_feature (437)..(437): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggagcctggggcctnagtgaaggtctcctgcaaggcttctggctacacctcaccggcgactatctccacgtgggtgcgacacggcccctggacaagggcttgagtggatgggatggatccaaaccccctaacaagtggtcggcaaacaaactntgcaacagaagtttcgagggcagggtcacatgacgagggacacgtcagtcagcaacacgacctacagtggganctagagccaagctgacatctaagaccgacgaccggccttaatttacttacgttggttagcggtaaggtctttcgggtttaccgggttggtccgtttcgggtttttccgg

SEQ ID NO: 348426 - DNA, 542 bp, Homo sapiens
  misc_feature: GZ8MTXP01AFETU.45.37.D04.1.454.CMB.2.raw
  modified_base (455)..(455): a, c, t, g, unknown or other
  misc_feature (455)..(455): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcagtgaaggtctcctgctaaggttctggctacaccttcaccggcgactatctccacgtgggtgcgacacggcccctggacagggcttggagtggagtgggatggatacaaccctaacaagtggtggacacaaaactatgcacgagagtttcgagggcagggtcacgatcgacgagggacacgtcatcacgcacacgacctacgagtggagcgtgagcagactgacatcgngaacgacgacggtccttagtttactacgttgttgcggaaggtgttcggtttacgggtggttacgtttcggttttccgttttaacggg

SEQ ID NO: 348427 - DNA, 565 bp, Homo sapiens
  misc_feature: GZ8MTXP01A89X5.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctacaacaataagaactactagcttaggtaccagacaagaaaccaggtacacgcctacctaagctgctctatttacgtggcatccgtaacccgggaacgtccggggtccccctaggaccgtattcgaggtggcaaggcgggtcgtgggactagtattcactctcaccatcagcacgcctgcaggctagaaagtcgtgggtggtacttagtttatcggcttgtacagtactaaattattattataacttccttacgtacgtttccggacccgtagggaaccttaaggttcggtaataacgtcaaaacgtcttgtaacggctaacg

SEQ ID NO: 348428 - DNA, 691 bp, Homo sapiens
  misc_feature: GZ8MTXP01D8QT6.45.37.D04.1.454.CMB.2.raw
  modified_base (284)..(284): a, c, t, g, unknown or other
  misc_feature (284)..(284): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctggaggtgaggaagccgtggggcctcagtgaaggtctcctgcaggctctgctacacctcacggcgactatctccactgggtncgacgacggcccctggacgaagggtcttggaggttggagttggggatgggaactccgtaaacccccctaacgaagtgggtaggaccaaaacgtaaacctgttaggacccaaacgtaggtaaacgttttcggaagggggtacgtaacggggttaccaaccgtaacgtaccggaaaccgtaacgggggaaccctaaaccgggttaccctaaacggtaccaaaccgggccaaaaaaaaccgccggtaaccccggttaaacccaggtttacgggaacggttaccgtacggaaggacaaacgaccggtaacgacgtacgtcgaacgaaccgacgtaccgttacttaagtttacttcgttgttacgtaaggtagttaacggtttcggttacggttcggttcgtttcggtttcg

SEQ ID NO: 348429 - DNA, 649 bp, Homo sapiens
  misc_feature: GZ8MTXP01CNVJS.45.37.D04.1.454.CMB.2.raw
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
  modified_base (249)..(249): a, c, t, g, unknown or other
  misc_feature (249)..(249): n is a, c, g, or t
  modified_base (275)..(275): a, c, t, g, unknown or other
  misc_feature (275)..(275): n is a, c, g, or t
  modified_base (306)..(306): a, c, t, g, unknown or other
  misc_feature (306)..(306): n is a, c, g, or t
  modified_base (364)..(364): a, c, t, g, unknown or other
  misc_feature (364)..(364): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgagagcgtgggcctnagtgagtctctgcagntctgctacnctcacggcactatctccacgtgggtncgacacggcccctggacgaggtctgagtggngtgggatggactaccgaaaccccctaaacgaagtcgggtaggaccaaaactaaacctntagacctaacgaggtaacgtttcgaggggcgtaaggggtccaacctagtacgaaccgacggggacctacgtcccaatccgaagccgaacgacggtacccttaacggacggttacgggacgtcgtacggaacgaccgaaggtaccctaggactacttccgtaacgggaacccgaccgtaaccggacctttaaagttttacgttaaccgttggttacggtaaccggtaagggtcgttttcggggttttaccgggttcggttccggttttccggggttttttaacccg

SEQ ID NO: 348430 - DNA, 624 bp, Homo sapiens
  misc_feature: GZ8MTXP01DEL10.45.37.D04.1.454.CMB.2.raw
  modified_base (390)..(390): a, c, t, g, unknown or other
  misc_feature (390)..(390): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtgggcctcgagtgaggtctctgcagctctgctacacctcaccggcactactctccacgtgggtgaccgacgacggtcccccgtaggaaccgaaggggtctttaggaggttgggagtgggagttagggactaccaaacccccgttaacagtcgggtaggacaaaacaaactntgaccaacgaaggtaacgtttcgaggggacgagggtaccacgagtacgaccgagggaccacgtccagtcacgacacgacgtacctacgaacgtggacgcgtagacgacgaacgacgtagactacgttcgtaacggaaccgaccgtaccggttaccttaagtttaacttacgttggttacggcggtaaggtcgtttacgggtttaccgggttggttccgtttcgggttttaaccg

SEQ ID NO: 348431 - DNA, 460 bp, Homo sapiens
  misc_feature: GZ8MTXP01DN6JR.45.37.D04.1.454.CMB.2.raw
  modified_base (345)..(345): a, c, t, g, unknown or other
  misc_feature (345)..(345): n is a, c, g, or t
  modified_base (367)..(367): a, c, t, g, unknown or other
  misc_feature (367)..(367): n is a, c, g, or t
  modified_base (388)..(389): a, c, t, g, unknown or other
  misc_feature (388)..(389): n is a, c, g, or t
  modified_base (391)..(391): a, c, t, g, unknown or other
  misc_feature (391)..(391): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
  modified_base (397)..(398): a, c, t, g, unknown or other
  misc_feature (397)..(398): n is a, c, g, or t
  modified_base (400)..(400): a, c, t, g, unknown or other
  misc_feature (400)..(400): n is a, c, g, or t
  modified_base (402)..(405): a, c, t, g, unknown or other
  misc_feature (402)..(405): n is a, c, g, or t
  modified_base (407)..(407): a, c, t, g, unknown or other
  misc_feature (407)..(407): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (444)..(444): a, c, t, g, unknown or other
  misc_feature (444)..(444): n is a, c, g, or t
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
tcagacgcgatcgacacgaccggtgctcgatttagtagcatactgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctcaacaataagaactactagctggtaccagcagaaaccaggtcagcctctaagctgctcatttactggcatctaccggatccgggtcccctgacgatcagtgcngcggtctgggacagattcactntcaccatcagcagcctgcagnnanangngnntntnnnnantatatatntntcttctcttcgtcgtcgacgagagaanataacacacntgngtg

SEQ ID NO: 348432 - DNA, 631 bp, Homo sapiens
  misc_feature: GZ8MTXP01DNERD.45.37.D04.1.454.CMB.2.raw
  modified_base (469)..(469): a, c, t, g, unknown or other
  misc_feature (469)..(469): n is a, c, g, or t
tcagacgcgatcgacacgaccggtgctcgatttagtagcatactgttggggtttgggggcatcaccccagcaaccacatctgtcctctagagaatccccctgagagctccgttcctcaccatggactggacctggaggatcctcttcttggtggcagcagccacaagagccccactccccaggtgcagctggtgcagtcgtgggggctgaggtgaggaagccgtgggggcctcgagtgaaggtctcctgcaagggtcttctggctacaccttcgaccggcgactatctccacgtgggtgcgacacggccccctggacgaagggtcttggagtggagtgggatggactcaaaccctaacagtggtacgcaaacaaaactatcgcaacgagtaacggtttcgacgggacgaggggtccaaccgatacggacgaggacacgtacatcagcacacgaccctagacgtgggacncgtgacgcagaacgtgaacctagtcgacggaacgtaacccgaccgggtaccttaaagttttaacgttcgttaggttcggttaccgggtaagggttaacgtttcggggttttaacccgggtgggtttaccgtttcggggtttttcccgtttttaacccggggg

SEQ ID NO: 348433 - DNA, 507 bp, Homo sapiens
  misc_feature: GZ8MTXP01BCUWR.45.37.D04.1.454.CMB.2.raw
  modified_base (315)..(315): a, c, t, g, unknown or other
  misc_feature (315)..(315): n is a, c, g, or t
  modified_base (360)..(360): a, c, t, g, unknown or other
  misc_feature (360)..(360): n is a, c, g, or t
  modified_base (446)..(446): a, c, t, g, unknown or other
  misc_feature (446)..(446): n is a, c, g, or t
  modified_base (452)..(452): a, c, t, g, unknown or other
  misc_feature (452)..(452): n is a, c, g, or t
  modified_base (490)..(490): a, c, t, g, unknown or other
  misc_feature (490)..(490): n is a, c, g, or t
tcagacgcgatcgacacgaccggtgctcgatttagtagcatactgttgggtttgggggagctacaacaggcaggcaggggcagcaagatggtgttgcagactcaggtcttcatttctctgttgctctggatctctggtgcctacggggacatcgtgattacccagtctccagactccctggctgtgtctctgggcgagagggccaccatcaactgcaagtccagccagagtgttttagacagctccaaacaataaagaactactagcttggtaccagcaagaaaccaggtcagcctcctaagctgctcatttacnggcatctacccgggaatccggggtccccctgaccgatcagtggcnggcgggtctggggacagtatttcactctcaccatcagcagcctgcaggctagaagagtgggtggactaggttttatgtctgtcagntaaatnttatataattcttcgtacttcgcctggacagttgaatnaacaaagacttgtgctg

SEQ ID NO: 348434 - DNA, 527 bp, Homo sapiens
  misc_feature: GZ8MTXP01D8KFB.45.37.D04.1.454.CMB.2.raw
  modified_base (357)..(357): a, c, t, g, unknown or other
  misc_feature (357)..(357): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggagcctggggcctcagtgaaggtctcctgcaaggcttctggctacacctcaccggcgactatctccactgggtgcgacacggcccctggacaagggcttgagtggatgggatggatcaaccccctaacaatggtgcaaacaaactntgcaacgagtaagtttcgagggcagggtcaccatcgaccgagggaccacgtccatcagcacacgcctacagtggagctgcgcaagctgacatcgaagacgacgacggacctatttacttacgttgttgaacgtaggtgttcggttacggttgtcgttcggttttaaccgg

SEQ ID NO: 348435 - DNA, 548 bp, Homo sapiens
  misc_feature: GZ8MTXP01EQ6YY.45.37.D04.1.454.CMB.2.raw
  modified_base (294)..(294): a, c, t, g, unknown or other
  misc_feature (294)..(294): n is a, c, g, or t
tcagacgcgatcgacacgaccggtgctcgattttagtagcatactgtttggggtttgggggcatcacccagcaaccacatctgtcctctagagaatcccctgagagctccgttcctcaccatggactggacctggaggatcctcttcttggtggcagcagccacaagagcccactccccaggtgcagctggtgcagtcgtggggctgagggtgaggaagccgtgggggcctcagtgaaggtctcctgcaaggcttctggctacaccttcaccggcgactatctccactggggtncgacaggcccctggacaagggcttgagtggatggggatggatacaaccctaaccaatgggtggacacaaaaaactatgacacgagtaagtttcaggggcagggtcacatgacgaggacacgtcatcagcacaagcctacgatggagcgtgagcagactggacatctgaacgacaccggccttaagtttacttaacgttgttgttcggaaggtagttggtttaccgggtgcgtttggttttccgtttttaacggg

SEQ ID NO: 348436 - DNA, 569 bp, Homo sapiens
  misc_feature: GZ8MTXP01A18ZK.45.37.D04.1.454.CMB.2.raw
  modified_base (371)..(371): a, c, t, g, unknown or other
  misc_feature (371)..(371): n is a, c, g, or t
  modified_base (438)..(438): a, c, t, g, unknown or other
  misc_feature (438)..(438): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctcgagtgaaggtctcctgcaaggcttctggctacacctcaccggcgactatctccactgggtgcgacacggccccgtggacaagggtcttggagtggagtgggatggatccaaaccccctaacaagtggtggacaaacgaaactntgacacgagtaagttcgagggcagggtcacagtcgaccgagggacacgtcatcgagcacacgcctanagtggagctgagcaggactgacagttcaaggaaccgacaccgggccgtaaattttacgttaccgttggttaggcggtaggtaacgtttcgggtttaccgggttggttaaccgtttgggtttttaaccccgg

SEQ ID NO: 348437 - DNA, 665 bp, Homo sapiens
  misc_feature: GZ8MTXP01EUK5Y.45.37.D04.1.454.CMB.2.raw
  modified_base (252)..(252): a, c, t, g, unknown or other
  misc_feature (252)..(252): n is a, c, g, or t
  modified_base (346)..(346): a, c, t, g, unknown or other
  misc_feature (346)..(346): n is a, c, g, or t
tcagacgcgatcgacacgaccggtgctcgatttagtagcatactgtttggggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtgggggcctcagtgaaggtctcctgcaggcttcnggctacaccttcaccggcgactatcctccacgtgggtgcgacgacggcccctggacaagggctggagtggatgggatggactacaaaccctaanagtggtagacaacaaaaactatgacaacgaaggtaagtttacgaggggctaaggggtacaccgaagtcggaaccgaaggggaacctaaccggtaccaactacgaacgaccaacgaacgcccttaacgagtcgggaaagtccgtaggacgaccgaacggtaacttacggaaactacgttaccgtaggaaacccggtaaccgttaaaccgggtaccttaaacgttttacgttaaacgttggttacggttacggtaaggttacgtttaacgggttttaacccgggtggttaccgttttcgggtttttccgtttttaaccggg

SEQ ID NO: 348438 - DNA, 529 bp, Homo sapiens
  misc_feature: GZ8MTXP01BHGUW.45.37.D04.1.454.CMB.2.raw
  modified_base (341)..(341): a, c, t, g, unknown or other
  misc_feature (341)..(341): n is a, c, g, or t
  modified_base (359)..(359): a, c, t, g, unknown or other
  misc_feature (359)..(359): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctggggcctcagtgaaggtctcctgcaaggcttctggctacacctcaccggcgactatctccactgggtgcgacaggccccctggacaagggcttgagtggatgggatggatcaaccccctaanatggtggcaaacaaactntgcacagaagtttcagggcagggtcaccatgaccagggacacgtccatcagcacagcctacagtgagctgacgcaggctgacactctgaccgacacgggcctagtttacttacgttgttcgaacgtagggtaagttcggtttaccgggttgggtccgtttggttttcccg

SEQ ID NO: 348439 - DNA, 539 bp, Homo sapiens
  misc_feature: GZ8MTXP01EEAIO.45.37.D04.1.454.CMB.2.raw
  modified_base (458)..(458): a, c, t, g, unknown or other
  misc_feature (458)..(458): n is a, c, g, or t
tcagacgcgatcgacacgaccggtgctcgatttagtagcatactgtttgggtttgggggcatcacccagcaaccacatctgtcctctagagaatcccctgagagctccgttcctcaccatggactggacctggaggatcctcttcttggtggcagcagccacaagagccccactccccaggtgcagctggtgcagtctggggctgaggtgaggaagccgtggggcctcagtgaaggtctcctgcaaggcttctggctacaccttcaccggcgactatctccactgggtgcgacacggccccctggacaagggcttgagtggatgggatggatcgaaacccctaacaatggtggacacaaaactatgacacaagtaagtttcagggtcagggtcacatgaccgagggacacgtacatcagcacagcctacgacgtggagctgagcagaactgacatccngaacgacaccggcttaagtttatacgttgttgacgtaaggtatttggttaccgggtggttcctttcgggttttcctttggg

SEQ ID NO: 348440 - DNA, 553 bp, Homo sapiens
  misc_feature: GZ8MTXP01BQD0J.45.37.D04.1.454.CMB.2.raw
  modified_base (427)..(427): a, c, t, g, unknown or other
  misc_feature (427)..(427): n is a, c, g, or t
  modified_base (476)..(476): a, c, t, g, unknown or other
  misc_feature (476)..(476): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagccgtggggcctcagtgaaggtctcctgcaaggcttctggctacacctcaccggcactatcctccacgtgggtgccgacacggcccctggacaagggcttgagtggagtgggattggataccgaaaccccctaacagtgggtggacaaaacaaactgtgacagtaagaagtttcgagggcagggtacaccatacgaccgagggacacgtcancagcacacgacctacgaagtggaagctgacgacacgactgaacctgtcnggacgttacacggttaccctatttacttacgttgttagcgagtcgttaggttaccggttgtcgttgttttaacccgg

SEQ ID NO: 348441 - DNA, 648 bp, Homo sapiens
  misc_feature: GZ8MTXP01A2973.45.37.D04.1.454.CMB.2.raw
  modified_base (262)..(262): a, c, t, g, unknown or other
  misc_feature (262)..(262): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcaaggcttctggctacncctcgaccggcgactatcctccacgtgggtgcgacgacggccccgtggacgaagggtcttggaggtggagtgggatggactacaaccccctaacaaagtggtagacaaacaaactgtacgacaacagtaagtttcgagggtcgagggtcaccagtacgacgaggtacacgtacagtcagacacgaacgcctaacgagtacggacgccgtaggacgaccgaagggacctacggtaaactacgtaccggtaacgaacccgaaccggacccggttaccttaaacgttttaacgtttaccgttggtttacgggaacgggttaacggtcggtttacgggttttaaccccggggttgggttcccggtttttccggggttttttaaccccggg

SEQ ID NO: 348442 - DNA, 614 bp, Homo sapiens
  misc_feature: GZ8MTXP01CIR33.45.37.D04.1.454.CMB.2.raw
  modified_base (400)..(400): a, c, t, g, unknown or other
  misc_feature (400)..(400): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaagccgtggggcctgagtgaaggtctcctgcaaggtcttctggctacaccttcacccggcgactactcctccacgtgggtgccgacgacgggcccccgtaggaccgaaggggtcctttaggaggtgggagtggggatgggtataccccaaaccctaacaagtgggtaggaaccaaacaacgtntacgcaacgagtaagtttacgaggggtacgaggggtaccaaccgagtacggaacccgaagggaccacgtcccaagtccagaccaacgacgggacccttaacgagtcgggaacgtccgaggagacgagtacctagacagtcgtagacgtacacggtacctagtttacttacgttgtaagcgtaagtgttcggttaccggtggttcgttttccggg

SEQ ID NO: 348443 - DNA, 615 bp, Homo sapiens
  misc_feature: GZ8MTXP01AWQN7.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacacctcgaccggcgacctactccccgacgtgggtcgcgaccacgggcccccgtaggaacgaagggcttggaggtggagtggggatggactaccaaaccctaacgaagtggtggacaacaaaactagtcgacaacgagtaagttcgagggcagggtcacatcgacgagggacacgtacatcagacacgacgccctagagtggatcgagacgccgaagaccgtagaacgtaacttccgaggaaccgaacgacccggtacccttaagtttaacgtaacgttggttcggaccggtaaggtacggtttaacgggttttacccgggtcggttaccggtttcgggtttttcccgtttttaacgggg

SEQ ID NO: 348444 - DNA, 602 bp, Homo sapiens
  misc_feature: GZ8MTXP01BKR8P.45.37.D04.1.454.CMB.2.raw
  modified_base (294)..(294): a, c, t, g, unknown or other
  misc_feature (294)..(294): n is a, c, g, or t
  modified_base (352)..(352): a, c, t, g, unknown or other
  misc_feature (352)..(352): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttcgtggctacaccttcacccggcgactatcctccacgtgggtncgacacggcccctggacgagggcttggagtggatgggatggactacccaaaccctaanaagtgggtagaacaacaactatcgacaacgagtaagtttcgaaggggcaggggtacaaccgagtcgaaccgaggggacctacggtccagcaagcaacgacggccctagacgtgggaacgtcgtgagacgtacgacgtacgactactcggtacgaccggaacaccgggtaccttaagttttacttccgttaggtggaccgggtaagggttacgtttacggggtttaccgggtgggtttcccggtttttggg

SEQ ID NO: 348445 - DNA, 514 bp, Homo sapiens
  misc_feature: GZ8MTXP01DRPSL.45.37.D04.1.454.CMB.2.raw
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
  modified_base (361)..(361): a, c, t, g, unknown or other
  misc_feature (361)..(361): n is a, c, g, or t
  modified_base (449)..(449): a, c, t, g, unknown or other
  misc_feature (449)..(449): n is a, c, g, or t
  modified_base (472)..(472): a, c, t, g, unknown or other
  misc_feature (472)..(472): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
  modified_base (502)..(502): a, c, t, g, unknown or other
  misc_feature (502)..(502): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctggggcctcagtgaaggtctcctgcaaggcttctggctacacctcaccggcgactatctccactgggtncgacnggcccctggacaagggcttgagtggatgggatggatccaaccccctaacaatggtggcaaacgaaactntgcacagaagtttcagggcagggtcaccatgaccgaggacacgtccagtcagcacagcctacatggacgctgagcaagctggacattnaagaccgacacggcctaagtttnttacgttgttacggngagtntcggttcggngtcgttgtttcg

SEQ ID NO: 348446 - DNA, 716 bp, Homo sapiens
  misc_feature: GZ8MTXP01BIOWD.45.37.D04.1.454.CMB.2.raw
  modified_base (229)..(229): a, c, t, g, unknown or other
  misc_feature (229)..(229): n is a, c, g, or t
  modified_base (349)..(349): a, c, t, g, unknown or other
  misc_feature (349)..(349): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctnagtgaaggtctctgcaggcttctggctacaccttcaccggcgactatctccagtgggtgcgacacggcccctggacaaggggcttgaggtggatgggatgggactacccaaacccctaanaaagtgggtacggaaccaacgaactagtcggaccaacgtaaggtaaacggttttcggaacggggtacgtaacgggggttcccaaaccgtagttaccggaacccgaaacggggggtaacctaccgggttacccaacgttaccgaacggtaccaaccggaacggggtaccccttaaacgacgttacggggaacgtcccgttagggaacggaccgtaaaggtaccgttacgggaacctaacgttcccgttagggaaacccggaaccggttaaccgggtacccttaattttaacgttacgttacggtaagggtaccggtaaggttaacgttcggggttttaaccgggtcgggtttccggtttttaaccggg

SEQ ID NO: 348447 - DNA, 619 bp, Homo sapiens
  misc_feature: GZ8MTXP01C359E.45.37.D04.1.454.CMB.2.raw
  modified_base (251)..(251): a, c, t, g, unknown or other
  misc_feature (251)..(251): n is a, c, g, or t
  modified_base (456)..(456): a, c, t, g, unknown or other
  misc_feature (456)..(456): n is a, c, g, or t
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctcctgcaggcttcnggctacaccttcaccggcgactatctccacgtgggtgcgacacggcccctgggacaagggcttggagtgggagtgggagtggactaccaaacctaaacgagtggtcgacaacaaaactatcgacaacgaagtaacgttacgagggcgagggtcacgatacgacgaggacacgtacatcgacgacacacgcctaacgagtacggancgtagacgacgagtactgaactacgtccgtacggaacgtaccgaccggtaccttaagttttaaacgtcgttagggttcggttacgggtaacggttacggtttaaccgggttttaccgggtcgggttaccgtttttccggggttttaaccgtttttaaccgggg

SEQ ID NO: 348448 - DNA, 595 bp, Homo sapiens
  misc_feature: GZ8MTXP01DPRYQ.45.37.D04.1.454.CMB.2.raw
  modified_base (225)..(225): a, c, t, g, unknown or other
  misc_feature (225)..(225): n is a, c, g, or t
  modified_base (248)..(248): a, c, t, g, unknown or other
  misc_feature (248)..(248): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggatctggaggatcctcttcttggtggcagcagccacaagagcccactcccaggtgcagctggtgcagtcgtggggctggaggtgaggagccgtgggcctnagtgaaggtctctgcaagcttcngctacacctcaccggctactatcctccacgtgggtcgacgacgaccggcccctggaacgaagggtcttaggagtggagtgggatggactaccaaacccccgtaataagtcggtacggaccaaaacaaactgtagacaacgaagtaacgttcgagggacgaggtccaacgagtacgaccgaggacacgtcagtacacgcaacgacgacctaacgagtcggagcgagcgacgaagaccgtgaactctcgaacggaacgttacgaccggttaccttaagtttacgttacgttggttacggcgtaagggtctttcgggttacgggttcggttccgtttcggtttttaaccg

SEQ ID NO: 348449 - DNA, 740 bp, Homo sapiens
  misc_feature: GZ8MTXP01DW2PW.45.37.D04.1.454.CMB.2.raw
  modified_base (253)..(253): a, c, t, g, unknown or other
  misc_feature (253)..(253): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaggtctcctgcaggcttcgnggctacacctcgaccggcgactatcctccgacgtgggtcgccgacgacggcccccgtggggaaccaaggggtccttaggacggtgggagtggggattgggactacccgaaacccccttaacgaaagttcgggtacggaccaaaaccgtaaactaatacgggaccaaacccgtaaaggttaaacgtttcgggaacgggggtaccgaacgggggttacccaacccgtagtacgggaaccccgaagggggaaacccgaccggttacccaagtaccgaacgccaaacgacccggtacctaacccgtagttagggacgtccgtaggacggacgaaacggtctagggaaccctagttaccgtaaggaacccgacccggtaaccggttacctttaaacgttttaacgttaccgttggttacggtaacgggtaaaggttggttttaccgggttaccgggttcgggtttccgttttcggggtttttttaacccggg

SEQ ID NO: 348450 - DNA, 663 bp, Homo sapiens
  misc_feature: GZ8MTXP01BU5F4.45.37.D04.1.454.CMB.2.raw
  modified_base (256)..(256): a, c, t, g, unknown or other
  misc_feature (256)..(256): n is a, c, g, or t
  modified_base (487)..(487): a, c, t, g, unknown or other
  misc_feature (487)..(487): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagcgtgggcctgagtgaacggtctctgacgtaaggcttcgnggactacacctcgaccggcgtactactccgtaccacgtcgggtcgacgaccgaccggtccccgtagggaacgagggtcttaggacggtggacgtgggtactggaactaccgaaaccccctaagagtggtacgactaaaacaatgtcgacaacgagtagttacggagggacacgggtacacgtagacgacgaggaaccacgtacagacgacgtaacacgaccgtacctaagnggtacgacgtcgacgacgaccgtaaagacgtacgaacctacgtccggaaccggaaccgttaaccgtaccggttcgtttaaactttcggttaacgttgggttaacggtaacgggtaacgggtttcggtttaccggggttcggttcgggtttaaccgttttcgggtttttaacccggg

SEQ ID NO: 348451 - DNA, 665 bp, Homo sapiens
  misc_feature: GZ8MTXP01CRHZ3.45.37.D04.1.454.CMB.2.raw
  modified_base (251)..(251): a, c, t, g, unknown or other
  misc_feature (251)..(251): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctcctgcagcttcnggctacactcacggcactactctccacgtgggtcgcgacgacggtcccctaggacgaagggtcttggagttggagtgggatggataccgaaaccccctaagaagtgggtacgacaaaacgtaaactgtacgacaaacgtaggtaacgtttacgaggggacctaggggtacaaccgtaacgtacgaaccgaaggggtacctaaccggtaccaacgtacagaccaaccgacgaccctaaacgtacgtaggacgcgtacggaacgaccgaaaggaccctaggaaacctacgttacccgtaaggaaacccgaacggtacccggttacctttaaagttttaacgttacgttaggttacgaacggtaaggtaacgtttcgggtttacccgggttggttaaccgtttcgggttttaaccgg

SEQ ID NO: 348452 - DNA, 667 bp, Homo sapiens
  misc_feature: GZ8MTXP01AJ2Y5.45.37.D04.1.454.CMB.2.raw
  modified_base (256)..(256): a, c, t, g, unknown or other
  misc_feature (256)..(256): n is a, c, g, or t
  modified_base (410)..(410): a, c, t, g, unknown or other
  misc_feature (410)..(410): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagcgtggtgcagtcgtggggctgaggtgaggagccgtggggcctcgagtgaaggtctcctgcaggtcttcgnggcctactaccctcgaccggcgtaactactccgtccacgtgggtcgcgaccgacggccccgtaggaacgtaacgggcttaggaggtggagtggggtatcgggtactaccaaaccccccgttaagaagtcgggtacgacaaaaccgtaaacttgnggaaccaacgtaggtacgttacggagggcgaacgggtcaaccgagtccggaaccgacgggaacctacgtaccagtcgacgcacgacgacctaacgagtcggaacgtgcggagacgtaacgcgtacgacgtacgttcgaacgaacgaccgtaccggttactttaaacgtttacgttacggttgttccgggtaacggttaaggtcgttttaaccggggtttacgggttcgtttaaccggttttcgggtttttaacccgg

SEQ ID NO: 348453 - DNA, 642 bp, Homo sapiens
  misc_feature: GZ8MTXP01AYUML.45.37.D04.1.454.CMB.2.raw
  modified_base (383)..(383): a, c, t, g, unknown or other
  misc_feature (383)..(383): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctgaggtgaggaagccgtgggcctcagtgagtctcctgcaggcttctggctacacctcgaccggcgactatcctccacgtgggtcgcgacgaccggtccccgtaggaccgaagggcttaggaggtggagtgggatggactaccgaaaccccctaagaagtggtacgactaaaacaaactntcgacaacgagtaagttcgagggtcgaggtacacgagtcgaccgagggacaccgtcagtcacgcaacgacgacctaacgagtaggacgcgtaggacgaccgaaggactacgaactacttccggaacggaaaccggaaccgtaacccggttaccctttaaagttttaacgttaccgttagggttcggtaacggtaaacgggttcgtttacggggttttaccggggttcggtttccggttttcggggttttttaaccccgg

SEQ ID NO: 348454 - DNA, 650 bp, Homo sapiens
  misc_feature: GZ8MTXP01EIHZ4.45.37.D04.1.454.CMB.2.raw
  modified_base (328)..(328): a, c, t, g, unknown or other
  misc_feature (328)..(328): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagaggccatcatcaactgcaagtccagccagtagttgtttagacagctaccaaacaataagaactacttagcttaggaaccagacaagaaaccaggtacacgccctactaacgctagctactatttacgngggctacgtccgtaacccggggtaacgtccccccggggtccctagacccgtagttccgaacgggtcggcgtacgggtccggggttacgtacggggactaggtacttttcccaaccttcctacccaacctactaccagaccgtacgccctagccgagggactaagggaagtggggttggttagggtacttagtttacgtgtccgttggtaacagtaacttaaatttatttaataactttaccttcccgtaccgttcgtttcccggaccgttacgggttaaccttaaggtgtaattaacgtaacgaaccgttattcggttgccg

SEQ ID NO: 348455 - DNA, 587 bp, Homo sapiens
  misc_feature: GZ8MTXP01D76Z0.45.37.D04.1.454.CMB.2.raw
  modified_base (321)..(321): a, c, t, g, unknown or other
  misc_feature (321)..(321): n is a, c, g, or t
  modified_base (381)..(381): a, c, t, g, unknown or other
  misc_feature (381)..(381): n is a, c, g, or t
  modified_base (446)..(446): a, c, t, g, unknown or other
  misc_feature (446)..(446): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgtttagacagctaccaaacaataagaactactagcttaggtaccagacaagaaaccaggtcacgcctactaagctgctctatttacgnggcataccgtacccgggacgtcccggggtccccctacggaccgtattcgaggtcgggacngggcgggtcgtaggggactaggtactttcgactctacaccatcagcagcctgcgaggctagaagngttggggtggtactagtttatggctgtacaagtactaaatttatttattattaaccgttccttaccgttacgtttccggaccgtacgggttaaccgttaaggttcggtaatactaacgtaaacgattcggtcgttctaacg

SEQ ID NO: 348456 - DNA, 555 bp, Homo sapiens
  misc_feature: GZ8MTXP01CDAC4.45.37.D04.1.454.CMB.2.raw
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
  modified_base (434)..(434): a, c, t, g, unknown or other
  misc_feature (434)..(434): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggagatcctcttcttggtggcagcagccacaagagcccactcccaggtgcagctggtgcagtctggggctgaggtgaggagccgtggggcctnagtgaaggtctctgcaggcttcngctacaccttcaccggcgactatcctccacgtgggtgcgacgacggcccccgtaggaacgaaggggtctttaggaggtggagttgggatggactacccaaaccctaagaagtggtacgaacaactaactatcgacaacagtaacgttcgagggcgagggtcacagtcgacgagggacacgtcancagcacagctacgatggagcgagagacagactagacagtctagacgaacaccggtaccttaatttacttcgttgtcggacgtaaggttacgttacgggtttacggtcggttcgttttcggg

SEQ ID NO: 348457 - DNA, 561 bp, Homo sapiens
  misc_feature: GZ8MTXP01DQWAA.45.37.D04.1.454.CMB.2.raw
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
  modified_base (371)..(371): a, c, t, g, unknown or other
  misc_feature (371)..(371): n is a, c, g, or t
  modified_base (486)..(486): a, c, t, g, unknown or other
  misc_feature (486)..(486): n is a, c, g, or t
  modified_base (542)..(542): a, c, t, g, unknown or other
  misc_feature (542)..(542): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcgtggggcctnagtgaaggtctcctgcaaggcttcnggctacacctcaccggcgactatcctccacgtgggtcgcgacacggcccctggacgaagggcttgagtggagtggatggactaccaaaccccctaacaagtggtacggcaaaacaaacttngacaacagtaagttcgagggtcagggtacaaccagtacgaccgaggacaccgtcaagtcagacaacgacgacctacgaagtggaacgcgtgacgacaacgtcgtagacctatcgngacgactacgaccttaagttacttacgttgttgaacggtagtgttcggttaccggngttcgttaacggttttccg

SEQ ID NO: 348458 - DNA, 641 bp, Homo sapiens
  misc_feature: GZ8MTXP01COZKQ.45.37.D04.1.454.CMB.2.raw
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
  modified_base (457)..(457): a, c, t, g, unknown or other
  misc_feature (457)..(457): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctnagtgaaggtctctgcaggcttcnggctacaccttcaccggcgactatcctccacgtgggtcgcgaccacggcccctaggacgaagggtcttggagtggagtgggatggactacccaaaccctaagaagtggtacggaaccaaactaactatagacctaagagtaacgtttcgacgggacgtaggggtccaaccgagtacggaaccgaacggggacctaccggtccanacgaaggaccaacacggggacccttaacgagtcgggaacgcgtaggacgacgagtacacggaactcgtaacgtacgacggtaaccttaccgggtaccttaagtttttacgttaccgttgggtaacgtacggtaagggttaacgtttcggtttaaccggggttcggttaaccggtttttccgggg

SEQ ID NO: 348459 - DNA, 522 bp, Homo sapiens
  misc_feature: GZ8MTXP01ALHB1.45.37.D04.1.454.CMB.2.raw
  modified_base (359)..(359): a, c, t, g, unknown or other
  misc_feature (359)..(359): n is a, c, g, or t
  modified_base (486)..(486): a, c, t, g, unknown or other
  misc_feature (486)..(486): n is a, c, g, or t
  modified_base (506)..(506): a, c, t, g, unknown or other
  misc_feature (506)..(506): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacacctcaccggcgactatctccactgggtgcgacacggcccctggacaagggcttgagtggatgggatggatcaaacccctaacaatggtggcaaacaaactntgacacagaagtttcgacgggcaggggtcaccatcgaccgagggacacgtcatcagcacgagcctacagtggagctgagcgaagacgtgaacatcctgaacgacaccggctaatttaattacgttgngcgaggaattggttaccggnggtcgttggttttccg

SEQ ID NO: 348460 - DNA, 696 bp, Homo sapiens
  misc_feature: GZ8MTXP01DEVFX.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtgggctcagtgagtctcctgcaaggcttcgtggctacacctcaccggcgactactctcccagtgggtgcgaccgacggccccgtaggacgaagggctttggaggtggagtgggatggactaccaaaccccctaagaagtgggtaggaccaaaacgtaaactgtagaccaaacgaagtaacgtttcggaaggggaccggtaacggggttacaacccgtagtacggaacccgaacggggaaccgtaaccggttaccaacgtcaacggaccaacgaacggtaccccttaacggaacgttaggggaacgtccgtaggacgacgaaaggaccttacggaactcgttcggtaacgaacccgaacggtaacccggttacctttaaacgttttaacgttacgttcggttacgggtccggtaaagggttcgttttacggggtttacccggggttcggtttccggttttcgggttttttaacccggg

SEQ ID NO: 348461 - DNA, 540 bp, Homo sapiens
  misc_feature: GZ8MTXP01BHPLP.45.37.D04.1.454.CMB.2.raw
  modified_base (428)..(428): a, c, t, g, unknown or other
  misc_feature (428)..(428): n is a, c, g, or t
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
  modified_base (511)..(511): a, c, t, g, unknown or other
  misc_feature (511)..(511): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacacctcaccggcgactatctccacgtgggtgcgacacggcccccgtggacaagggtcttgagtggatgggatggataccaaacccctaacaagtggaggacaaacaaactgtagacaacgagtaaagtttcgagggacgagggtacaccgatcgaccgagggacacgtccancagcacagccgtacatggactcagagcaagacctagactactcaaggaccgacgaccgctatttattacgngttcggnaggtnttcggttaccggttgtcgttggttttccg

SEQ ID NO: 348462 - DNA, 590 bp, Homo sapiens
  misc_feature: GZ8MTXP01AYM00.45.37.D04.1.454.CMB.2.raw
  modified_base (467)..(467): a, c, t, g, unknown or other
  misc_feature (467)..(467): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagccccactcccaggtgcagctggtgcagtcgtggggctgaggtgaggaagccgtgggggcctcgagtgaaggtctcctgcaaggcttcgtggctacaccttcgaccggcgactactctccacgtgggtcgcgacgacggccccctggacgaagggcttggagtggagtggggatggactaccaaaccctaacgaagtggaggacaacaaaactatgacaacgtaagtaacgtttcgaaggggcgagggtacacgagtacggacgagggacacgtcatcgagacacacgcctacgagtcggancgtagacgacagactgaccatcgtgaacgaccgcggtaccttatttacgtacgttgttcggacggaagggtacttaacggggtttacccgggtggttaccgttcgggttttccgtttaacggg

SEQ ID NO: 348463 - DNA, 534 bp, Homo sapiens
  misc_feature: GZ8MTXP01EA96J.45.37.D04.1.454.CMB.2.raw
  modified_base (226)..(226): a, c, t, g, unknown or other
  misc_feature (226)..(226): n is a, c, g, or t
  modified_base (360)..(360): a, c, t, g, unknown or other
  misc_feature (360)..(360): n is a, c, g, or t
  modified_base (497)..(497): a, c, t, g, unknown or other
  misc_feature (497)..(497): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctnagtgaggtctcctgcagcttctggctacacctcaccggcgactatctccactgggtgcgacacggcccctgaaaccaagggcttgagtggatgggatggatcaaaccccctaacaatggtagcaaaacaaactntgacaaacaagtaaacgtttcgaggggtacaggggtcaaccgatagaaccgaaggggaaccacgtccatacagcacacgcctaacatggagctgagcaagactgacatcaagagacacgcctaatttattacgttgngcggaaggtgttggttacggttgtcgttggttttccg

SEQ ID NO: 348464 - DNA, 547 bp, Homo sapiens
  misc_feature: GZ8MTXP01CQ7AB.45.37.D04.1.454.CMB.2.raw
  modified_base (316)..(316): a, c, t, g, unknown or other
  misc_feature (316)..(316): n is a, c, g, or t
  modified_base (358)..(358): a, c, t, g, unknown or other
  misc_feature (358)..(358): n is a, c, g, or t
  modified_base (370)..(370): a, c, t, g, unknown or other
  misc_feature (370)..(370): n is a, c, g, or t
  modified_base (385)..(385): a, c, t, g, unknown or other
  misc_feature (385)..(385): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgcaagtccagccagagttgtttagacagctacaacaataagaactatagcttggaccagacaagaaaccaggtcagcctacctaagctgctcatttacnggcagtccgtaacccgggatcccggggtccccctaggacgtnttcgagtgggcnggcgggtctgggacngtatttcactctcaccatcagtcagtcctgcgaggctagaagagtggggtgtcgtagtttactgactgtcagtactaattattattataactcccgttacgtacttccggacctgggaaccttaaggttgtaatactaacaaacgtattggtaacgctaacg

SEQ ID NO: 348465 - DNA, 567 bp, Homo sapiens
  misc_feature: GZ8MTXP01BQBB6.45.37.D04.1.454.CMB.2.raw
  modified_base (375)..(375): a, c, t, g, unknown or other
  misc_feature (375)..(375): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccctcaccggcgactactctccacgtgggtgcgacacggcccctggacgaagggcttgaggtggagtgggatggatccaaacccccgtaacaaagtggtcggacaaaactaaactntgaccaacaagtaacgtttcgaggggcgacgggtcaccgatcgaaccgagggaccacgtcatacaacacagccctagagtggagctgagcgagactgaacctatcgagaaccgacgcgtaccttagtttatacgttgttcgcgtaaggtcgttcggtttacggtcggttcgttccggttttcgttttaacgg

SEQ ID NO: 348466 - DNA, 779 bp, Homo sapiens
  misc_feature: GZ8MTXP01C0Z0K.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcagtgaaggtctcctgcaaggcttctggctacacctcaccggcgactatctccacgtgggtgcgacgacggccccgtaggaccgaagggcttggagtggagtgggatggactccgaaacccccttaacgaagtgggtacggacaaaactaaaaccttaagtacggacaaaaccgtaagggtaaacggttttaccggaaacggggggaccgtaaacggggggttacccaaacccggtaaacgttacggaaaccccggaacgggggtaaacccaaccgggttaccccgaaattacccgaaacggaccgtaaacccaaccgggtaaccctttaaacgaaccgggttagggaacggacccgttaaggaacgggtacccaaagggtacccttaggaaaccctattacccgtaacgggaacccgaaacccgaaacggggttaccccgttaaatttttaaccgtttaaacgttggggttacggaaccggggttaagggtaagttttacggggttttaaccccggggttagggttccggttttaacgggggtttttttccccg

SEQ ID NO: 348467 - DNA, 614 bp, Homo sapiens
  misc_feature: GZ8MTXP01ERFQP.45.37.D04.1.454.CMB.2.raw
  modified_base (357)..(357): a, c, t, g, unknown or other
  misc_feature (357)..(357): n is a, c, g, or t
  modified_base (464)..(464): a, c, t, g, unknown or other
  misc_feature (464)..(464): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtgggggcctcagtgaaggtctcctgcaaggcttctggctacaccttcaccggcgactatcctccacgtggggtcgcgacgacgggcccccgtaggacgaagggtcttggagtgggatggggatggactacgaaaccctaanaagtggtacgacaacaaaaactatgacaacgagtaacgttcgaggggcacgggtcaccgagtcgacgagggacacgtacatcgagcacagccctaagacgtggaacncgtagacgccaagaccgtagacctaagtcgtacggaaaccgtaacgaaccgggtaccttaaattttaagttaccgttaggttcgaccgggtaagggtcgtttaacgggtttaccgggtggttccgtttaacggttttcccgttttaaggg

SEQ ID NO: 348468 - DNA, 580 bp, Homo sapiens
  misc_feature: GZ8MTXP01BI75B.45.37.D04.1.454.CMB.2.raw
  modified_base (351)..(351): a, c, t, g, unknown or other
  misc_feature (351)..(351): n is a, c, g, or t
  modified_base (468)..(468): a, c, t, g, unknown or other
  misc_feature (468)..(468): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccctcaccggcgactatcctccactggggtgccgacgacggcccctggacgaagggctttggagtggatgggatggatcaaacccccctaanagtggtgacaaacgaaactgtagcaacagtaagtttacgaggggcagggtacaccgagtcgaaccgaggggaccaccggtccactcgacgacacacgtccaacgtgtacggacgcgngagccaggactggactaactcgaacgaacggacaccggttcctaatttacgttacgttggttcgcggtaggtaagttcggtttaccgggttgttcgtttcggtttttcccgg

SEQ ID NO: 348469 - DNA, 584 bp, Homo sapiens
  misc_feature: GZ8MTXP01D6N3D.45.37.D04.1.454.CMB.2.raw
  modified_base (230)..(230): a, c, t, g, unknown or other
  misc_feature (230)..(230): n is a, c, g, or t
  modified_base (348)..(348): a, c, t, g, unknown or other
  misc_feature (348)..(348): n is a, c, g, or t
  modified_base (367)..(367): a, c, t, g, unknown or other
  misc_feature (367)..(367): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (439)..(439): a, c, t, g, unknown or other
  misc_feature (439)..(439): n is a, c, g, or t
  modified_base (450)..(450): a, c, t, g, unknown or other
  misc_feature (450)..(450): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctnagtgaaggtctcctgcaaggcttctggctacaccttcaccggcgactatctccactgggtgcgacacggcccctggacaagggcttgagtggatgggatggataccaaacccgtaaanagtggagaacaacaactangacaacgaagtaagttacgagggacgacggacaacagacgaacgacggactacgcancanacacacgactanagtaggagcgngagacgaacgtacgtacgacactaacgtacgaacggaaccgaaccggtaaccgttaactttaacgttacgttacggtaacggtacggtaacgggtacggttacgggtttaccggggttcgggttcggtttcggg

SEQ ID NO: 348470 - DNA, 611 bp, Homo sapiens
  misc_feature: GZ8MTXP01CGUGG.45.37.D04.1.454.CMB.2.raw
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagccccactccccaggtgcagctggtgcagtcgtggggctgaggtgaggaagccgtggggcctcagtgaaggtctcctgcaaggcttcgtggctacaccttcgaccggcgactatcctccacgtgggtgcgacgacggcccccgtggacgaagggtcttggagtgggagtggggatggactaccaaaccctaaccgaagtgggtagacaacaaaactagtgacaacgagtagttcgagggtcagggtacacgagtacgaccgaggacacgtccatcgacgacaacgacgtacctaacgagtacgggagaccgtaggaacgcgaaggaccgtacggaacctacgtaccgtacggaaccgaaccgaccggtaccttattttaacgtacgttggttcgcggtaagtacgttcggtttaccggtggttcgtttcggtttcgttttaacggg

SEQ ID NO: 348471 - DNA, 636 bp, Homo sapiens
  misc_feature: GZ8MTXP01DC1EV.45.37.D04.1.454.CMB.2.raw
  modified_base (510)..(510): a, c, t, g, unknown or other
  misc_feature (510)..(510): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcgaaggcttctggctacacctcaccggcgactactctccacgtgggtgccgacgacggccccgtggacgaagggcttggagtggagtgggatggataccaaaccccctaaacgaagtggtacggacaaaaccgtaaactgtacgaccaacgtaaaggtaacgtttcggaacggggtcaacggggtccaacccgtatacggaacccgaaggggaaccacggtaccactacgagccaacacgccgtaacgtagtacgggacgtacgngaacgccgaaggacctaggaacctagtcgtaacggaaccgacgtaccgggacctttagtttaacttacgttgttacggaacgtagtaacgtttcgggttaccggttggttcgttcgggtttttccg

SEQ ID NO: 348472 - DNA, 563 bp, Homo sapiens
  misc_feature: GZ8MTXP01EJS5X.45.37.D04.1.454.CMB.2.raw
  modified_base (361)..(361): a, c, t, g, unknown or other
  misc_feature (361)..(361): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacacctcaccggcgactatctccactgggtgcgacaggcccctggacaagggcttgagtggatgggatggatcaaaccccctaacaagtggtggacaaacaaactntgcacagtaagtttcgagggcagggtcaccagtgaccagggacacgtcatcagcacacgacctacagtggagctagagcaagactgactactctaacggacgacgaaccggcctaagttttaacttaacgttggttcggtaaccggtaggtaacgtttcgggtttacccgggttgggttccgtttcgggtttttaaccccgg

SEQ ID NO: 348473 - DNA, 667 bp, Homo sapiens
  misc_feature: GZ8MTXP01CF0II.45.37.D04.1.454.CMB.2.raw
  modified_base (353)..(353): a, c, t, g, unknown or other
  misc_feature (353)..(353): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaagccgtggggcctcgagtgaaggtctctgcaggcttctggctacacctcaccggcgactatctccacgtgggtgcgacacggcccctggacgaagggtcttgagtggagtgggatggactaccgaaacccccctaanaaagtgggtacggacaaaaccaaaactgtacgacaaaccgtaagtaacggtttacgaaggggtacgacggggttaccaaccgagttacggaaccgaaggggaaccctaccgggttaccataccgacgaccaacgaccggtacctaacgaagttcgggaacgcgtaggacgacaacgactaggactacgtcgtaacggaacgacgaaccggttccttaaagttttacttaccgttggttacggtaaccggtaaagggttaacgtttacggggtttaaccgggttcgggttaacgtttcgggttttttaaccccgg

SEQ ID NO: 348474 - DNA, 890 bp, Homo sapiens
  misc_feature: GZ8MTXP01CWCC7.45.37.D04.1.454.CMB.2.raw
  modified_base (335)..(335): a, c, t, g, unknown or other
  misc_feature (335)..(335): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgacccagtctccagacctcccgtggctgtcgtctcggtgggacgaggaccggaccaactactaccaactcggactaacgtccacgaccaggtagtttagttaacgacacgtacctaaccaaataaagtaaacgtaacttaacgtacgtcgttacggacaagacgaaacgaaacgngtcacgtccctactaagctcgtactactagtttacggtcggaccttaacgttaccccggtaaacccggtacttccccgggttacccggtaccccgtacggtaacccgttaacgtttacggaaacggggttcgggccggaacgggggtttcccgggggttaacggtaaccgggggaaacttaaacgggttttcccttaacccgtacgtttacccgtaacccaacccttaacgtaccgaacggtaaccgtaccggttcccgtagggaacccggaggggtaccttaaacggggaaaggttcggggttaggggttaacgggttaacctttaagggtttttaaccgaccggtccggtttaacggaaaccgttaaagtaaaccttttaaaagtttaacgttttaaactttaacccgtttaaacccgtttccccgggttttaacccggttaaccgggtttttacccgggaccccgggtttaaaacgggaaaaccgttaaaggggtccgtaaaacggttaactaaaaccggggtaaaaccttgggttcggttcggtaaacccg

SEQ ID NO: 348475 - DNA, 679 bp, Homo sapiens
  misc_feature: GZ8MTXP01BYU3J.45.37.D04.1.454.CMB.2.raw
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactccaggtgcagctggtgcagtcgtgggctgaggtgaggagcgtgggcctgagtgagtcnctgcagctcngctacnctcacggcactatctccacgtggcgcgacaggcccctaggacaagggtcttgaggtggatgggatggactacccaaacctagaagtggtaggaacaacctaacgtatacggacaaacgacggtaaacggtttcgaaggggaccgtaacggggtaccgaaccctaagtacggaaacccggaacgggggaaccaaccggttacccgaaacgtaccaaaccgggacaaaccgggttaacgaaccgttaaccgtaaacgggtacgggaacgaccgttaacggaacgaaccggaacgttaaccgtacggtaaacctacgtaacgtaacggaaccggtaaccgttaaccggtaaccgttaacgtttaacgttacgttacggtaacggtacggtaacggttacggttacggttaccgggttcgggttcggtttcgg

SEQ ID NO: 348476 - DNA, 611 bp, Homo sapiens
  misc_feature: GZ8MTXP01EHV5Z.45.37.D04.1.454.CMB.2.raw
  modified_base (387)..(387): a, c, t, g, unknown or other
  misc_feature (387)..(387): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtggggcctcagtgaggtctcctgcaaggcttcgtggctacaccttcgacccggcgactatcctccgacgtggggtcgccgaccgacgggcccccgtgggaaccgaagggggtcttggaggtgggagtggggatggactaccgaaacctaacagtggtagacaacaaaactntgacaagagtacgttcgagggcagggtcacgagtacggacgaggacacgtaccagtcacgacaacacgccctaaggagtggaagcgtagacgacgaggaacctggactagttccgaggaaccgtaacgttaccggtaccttaaatttacgttacgttggttcgacggtaaggttacgtttcgggtttaccggtcggttcggtttcggtttttccgtttaacggg

SEQ ID NO: 348477 - DNA, 596 bp, Homo sapiens
  misc_feature: GZ8MTXP01CU2FC.45.37.D04.1.454.CMB.2.raw
  modified_base (324)..(324): a, c, t, g, unknown or other
  misc_feature (324)..(324): n is a, c, g, or t
  modified_base (483)..(483): a, c, t, g, unknown or other
  misc_feature (483)..(483): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagtagttgtttagacagctaccaacaataagaactatagcttggtaccagacaagaaaccaggtacacgccctactaagctgctactatttacgnggcagtccgtacccgggactccggggtccccctaggaccgtattcgaggtcggcgaacggtccgggtcgtaggggactagtactttcaccgttctaccgaccatcgacgctacgccctgccgaggcctaggaagtgtaggggtcggtacttagtttacnggtctggtacagtactaattatttacttataactttcccgttcgttacgtttcccggaccgtaggaacccgttaaggttcgtaatacgtaacgaaacgtcaggttcgctaacg

SEQ ID NO: 348478 - DNA, 789 bp, Homo sapiens
  misc_feature: GZ8MTXP01AWOD4.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactgtacctggaggatcctcttcttggtggcagcagccacaagagcccactcccaggtgcagctggcgcagtcgtggggctggaggtgaggagccgtgggcctgagtgaggtctctgcagcttcgtggctacacctcaccggcgactatctccacgtgggtcgcgaccgacggcccccgtaggacgaagggtcttggacgttggagtcgggatgggactaccgaaaccccctaaacgaagttcgggtacggacctaaaaaccgtaaaacttcgtacgaaccctaaacggtaaacggttaaacgggttttaccggaaacgggggtaccgtaaaccgggggtttacccaaacccgtacggttaaccgggaaacccgggaaacggggtaaacccgtaaccccgggttaaccaaaccgttaccgaaaccgggtaaccaaaccgaaaccccgggtaccctttaaacggaacggttacggggaaccgttaccggtacggaaaggacccgtaaacggacccgttacgggtaaaccaccgttacgttaacggaaacccgacgtaaacccggttactttaaacgttttacgttaacgttcgggttacgtaacggtaaggttaacgtttacgggtttacccgggttgggtttccggtttccggttttttaacccggg

SEQ ID NO: 348479 - DNA, 566 bp, Homo sapiens
  misc_feature: GZ8MTXP01DY76N.45.37.D04.1.454.CMB.2.raw
  modified_base (228)..(228): a, c, t, g, unknown or other
  misc_feature (228)..(228): n is a, c, g, or t
  modified_base (248)..(248): a, c, t, g, unknown or other
  misc_feature (248)..(248): n is a, c, g, or t
  modified_base (367)..(367): a, c, t, g, unknown or other
  misc_feature (367)..(367): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctnagtgaggtctctgcagctcnggctacacctcaccggcgactatctccacgtgggtgcgacgacggcccctggaccgaagggcttgaggtggagtgggatggactaccaaaccccctaacagtggtagacaaacaaactngacacagtaagttcgagggcaggtcacatacgacgagggacacgtcagtcacgcacacgcctacagtaggactcgagagcaagtacctgactatcgtaacgacgaacgacggttacctaaagtttacttacgttggttacgaacggtaggtaacgtttcgggttacccgggttggtccgttttcgggtttttaacccgg

SEQ ID NO: 348480 - DNA, 728 bp, Homo sapiens
  misc_feature: GZ8MTXP01DOVSO.45.37.D04.1.454.CMB.2.raw
  modified_base (385)..(385): a, c, t, g, unknown or other
  misc_feature (385)..(385): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaagccgtggggcctcgagtgaaggtctccgtgcgaagggtcttacgcggctaccacccttcgaccggcgaactatcctccgtacgtgggtgccgacgaccggcccccgtagggaacgtaaggggctttggaggtaggacgtggggatggaactaccaaaccccccgtaanaagtggggtacggaccaaaaccgtaaactgtacgactaaacaggttaacggtttcggaacgggggtacgaacggggttaccaaaccgtagacggaacccggaagggaacccgtaacggtaccaagtaccgaacggacctaaacgaccggtacctaacgtaaggttcggaagtaccgtaggacggacctaaacggtactacggaacctacgttcgtaacggaaaccggacccgaacccgggttaccgttaaatttttcgttaccgttggttaccggtggtaaacggttcgtttacggggtttacccgggttgggttaacgtttttccggggtttttaacccggg

SEQ ID NO: 348481 - DNA, 600 bp, Homo sapiens
  misc_feature: GZ8MTXP01CCOQG.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagtcagagttgtttagacagctaccaaacaataaagaactactagcttggtaccagacaagaaaccaggtcagccctctaagctgctctatttacgtgggactagtccgtaacccggggaacttccccgggggtaccccctcggaccgtagttccgaaggttcgggacgaagggtcggggttacgtgggggactaggtacttttccaaccttctcaacccatcgaagcacgccctgaccgaggctaggaagagttcggggtagggtacttaggttttatgccgttgtcaatctaaattatttattactaacttccttcgtactttcggaccctgggaaccgaagttgtaatataacgaacgtacttggtcgcgtaacg

SEQ ID NO: 348482 - DNA, 596 bp, Homo sapiens
  misc_feature: GZ8MTXP01AP16V.45.37.D04.1.454.CMB.2.raw
  modified_base (345)..(345): a, c, t, g, unknown or other
  misc_feature (345)..(345): n is a, c, g, or t
  modified_base (370)..(370): a, c, t, g, unknown or other
  misc_feature (370)..(370): n is a, c, g, or t
  modified_base (456)..(456): a, c, t, g, unknown or other
  misc_feature (456)..(456): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttctggctacacctcaccggcgactatctccacgtgggtgcgacacggcccctggacgaagggcttgagtggatgggatggatccaaaccccctaanaagtggtacggacaaaacgaaactntgacaacgagtaagtttcgaggggcgaggggtccaaccgagtacgaaccgaaggggaccacggtccatccgagcacacgaccctanagtggacgcgtagaggcaaggactggaactactcgaaggaaccgacgaccggttacctaagttttaacttaccgttggttcgaaccggtaggtaacgtttcgggtttaccgggttcggttcgtttaacgggtttttcccg

SEQ ID NO: 348483 - DNA, 620 bp, Homo sapiens
  misc_feature: GZ8MTXP01BHULA.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagtagttgttttagacagctaccaaacaataagaactactagctaggtacagacaagaaaccaggtcagcctacctaagctgctctatttacgtggcagttccgtaacccgggtaacgtcccgggggtaccccctacggaccgtattccgagtcgggcgtaagggcgggtacgtaggggacagtactttcactctacaccatccaagccacgcctagacgaggtctaggaaagtgttggggtacggtcttaagttttatggtccttgtacaagtactaaatttatttaattattaactttcccgttcgttaaccgtttccggacccgttagggaaacccgttaaggttacggtaacttaactaaccgtaaaacggcttgggtcgcttaaccg

SEQ ID NO: 348484 - DNA, 674 bp, Homo sapiens
  misc_feature: GZ8MTXP01D7MQT.45.37.D04.1.454.CMB.2.raw
  modified_base (250)..(250): a, c, t, g, unknown or other
  misc_feature (250)..(250): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcgagtcgtggggctggaggtgaggagccgtgggcctgagtgaggtctctgcgagctcgngctacacctcgacgcgtactatcttcacgtgggtcgacgacgacggccccgtaggacgaacgggtcgttaggaggttaggaggttgggaagttggaactaccaaaacccccgtaacgaaagttcggggtacggaccctaaaactaaaaccttaagtacgaacgtaaaccgtaaggttaaacggtttccgggaagggtaccgacggggttaccaaccgagtacggaacccgaaggggtaacccaccggtaccaacgacgacgacaacgaccgtacctaacgaagtagggacgacgtagacgtacgaacggactaccggataacgtcgaacgaacgacgtaccggttacttaaacgtttattaacgttgttacggtgtaacgggtcgtttacgggttacgggttcgttcggtttcggttttaaccg

SEQ ID NO: 348485 - DNA, 597 bp, Homo sapiens
  misc_feature: GZ8MTXP01BEJMH.45.37.D04.1.454.CMB.2.raw
  modified_base (377)..(377): a, c, t, g, unknown or other
  misc_feature (377)..(377): n is a, c, g, or t
  modified_base (453)..(453): a, c, t, g, unknown or other
  misc_feature (453)..(453): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagccccactccccaggtgcagctggtgcagtcgtggggctgaggtgaggaagccgtgggggcctcgagtgaaggtctcctgcaaggtcttcgtggctacaccttcaccggcgactatcctccacgtgggtgccgacgacggcccccgtggacgaaggggcttggagtggagtgggatggactacaaccctaacagtggtagcaacaaaaactntgacaacgagtaagtttcgagggcgaggtcacgatcgaccgagggacacgtaccagtcagcacgtacgcctaaggngtggaatcgagacgcgtaaggacctaggacctacgtacgtcggaaccgaaccgttacggtaccttaagtttactaacttggttcgacggtaagggttacgttcggtttacgggtcggttcgtttcgggttttcccgtttaaggg

SEQ ID NO: 348486 - DNA, 679 bp, Homo sapiens
  misc_feature: GZ8MTXP01BM2CK.45.37.D04.1.454.CMB.2.raw
  modified_base (246)..(246): a, c, t, g, unknown or other
  misc_feature (246)..(246): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtgggcctgagtgaaggtctctgcagcttcnggctacactcgaccggcgactatctccacgtgggtgccgacgacggccccgtggacgaagggtctttaggagtggagtgggatggactaccaaaccccgtaacaagtggtacggacaaaacgaaactaagtcgaacaacgaagtaacggtttacgaggggtacgtacggggtacaacccgagtacggaaccgtacggggaacctacggttaccaacgtcaacgacaacgaccgaccttaacgagtacgggacgtacgtcggaacgacgtaacgacgttcggaactacgttcctaacgggaacccgttaaccgaccggttaccgtttaaacttttaacggtttaaccgttggttacggtaaccggttaagggttcgttttaccggggttttaccggggttacggttccgggtttttcggggttttttaaccccg

SEQ ID NO: 348487 - DNA, 625 bp, Homo sapiens
  misc_feature: GZ8MTXP01C2F2D.45.37.D04.1.454.CMB.2.raw
  modified_base (383)..(383): a, c, t, g, unknown or other
  misc_feature (383)..(383): n is a, c, g, or t
  modified_base (421)..(421): a, c, t, g, unknown or other
  misc_feature (421)..(421): n is a, c, g, or t
  modified_base (470)..(470): a, c, t, g, unknown or other
  misc_feature (470)..(470): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcagtgaaggtctcctgcgaaggcttcgtggctacacctcaccggcgactatctccacgtgggtgcgacgacggcccctggaccgaagggtcttggagttgggagttgggagtggataccgaaacccccctaagaagttgggcggaccaaaacaaactntagaccacgaagtaattcggaggggcagggtcaaccgngtacgaccagggacacgtcagtcagcacacgctaagcgtaggacgtacnggacgacgaacggaactcggaactctcgtaacgaccgaccgtaaccggccctttaaagtttctttaaccgggttgttacgggtaaccgggtaaagggttcgtttaaccgggttttacccggggttgggtttcccgttttcgggtttttttcccgg

SEQ ID NO: 348488 - DNA, 546 bp, Homo sapiens
  misc_feature: GZ8MTXP01EDM9D.45.37.D04.1.454.CMB.2.raw
  modified_base (364)..(364): a, c, t, g, unknown or other
  misc_feature (364)..(364): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagccgtggggcctcagtgaaggtctcctgcaaggcttctggctacacctcaccggcgactatctccacgtgggtgcgacacggcccctggacaagggcttgagtggatgggatggatccaaacccctaacaagtggtgacaaacaaactntgacaacagtaagtttcgagggacgagggtcacgatgaccgaggacacgtcatcagacacacgacctacagtaggagcgtagagcaaggactggacctatcgtaagaccgacgaccggcctaagtttattaacgttgttgcgaggtaacttggtttaccgggttgtcgtttcggttttccgg

SEQ ID NO: 348489 - DNA, 591 bp, Homo sapiens
  misc_feature: GZ8MTXP01BWK55.45.37.D04.1.454.CMB.2.raw
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (282)..(282): a, c, t, g, unknown or other
  misc_feature (282)..(282): n is a, c, g, or t
  modified_base (349)..(349): a, c, t, g, unknown or other
  misc_feature (349)..(349): n is a, c, g, or t
  modified_base (375)..(375): a, c, t, g, unknown or other
  misc_feature (375)..(375): n is a, c, g, or t
  modified_base (469)..(469): a, c, t, g, unknown or other
  misc_feature (469)..(469): n is a, c, g, or t
  modified_base (475)..(475): a, c, t, g, unknown or other
  misc_feature (475)..(475): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctgaggtgaggagccgtggggcctngtgaggtctctgcaggctnggctacnccttcaccggcactatctccagtggtcncgacacggccccctaggacaagggtcttagaggtggagtgggatggaactacccaaaccccgtaaanaagtggtacggaaccaaacgtaactntagaccaaactagtaaacgtttcgaagggctaagggtccaaccagtacgaacgagggaccacgtaccatcagacaacgacggaccctaagtagngggacnctgagccaggacctagacctatccaggaccacgacggtaccttaattttaccgttcgttaggtgtacggtaagggttactttcggggtttaccggtcgggtttcgttttcccgggg

SEQ ID NO: 348490 - DNA, 599 bp, Homo sapiens
  misc_feature: GZ8MTXP01E3CBF.45.37.D04.1.454.CMB.2.raw
tcagacgcgatcgacacgaccggtgctcgattttagtagcatactgttggggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctcctgcaaggcttcgtggctacacccttcgaccggcgactatctcctacgtgggtgcgacgacggcccctggacgagggctgagtggagtgggatggactacaaacctaacagtggtacgacaacaaaaactatcgacaacgaagtaagtttacgaggggcgacgggtacaacagtcgaacgagggaacacgtacactacgagacaacacgacctacggacgtgggacgcgtagacgacgaacgtacgtacgaccactccgtacggaaccgaaccgaccgggtaccttagtttaacttacgttggttcgacggtaagtagttcggtttacgggtggttacgtttcggtttcgtttaacggg

SEQ ID NO: 348491 - DNA, 576 bp, Homo sapiens
  misc_feature: GZ8MTXP01DJU2C.45.37.D04.1.454.CMB.2.raw
  modified_base (318)..(318): a, c, t, g, unknown or other
  misc_feature (318)..(318): n is a, c, g, or t
  modified_base (372)..(372): a, c, t, g, unknown or other
  misc_feature (372)..(372): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgtttagacagctaccaacaataagaactactagcttggtaccagcaagaaaccaggtcagccctacctaagcctgctctatttacgngggcatccgtaacccgggacgtcccggggtcccccctgacgtatcgagtcggcnggcgggtctagggacagtatttcactcctacaccatcagcacgcctgccgagctagaagtatggggtgtacttagtttatgcttgtcaagtactaaattatttaattattaactttccttccgttaaccgttccggtacccgtagggttaaccgttaaaggttggtaataacgtaacgaaacgtagttcgtaacggttctaacg

SEQ ID NO: 348492 - DNA, 590 bp, Homo sapiens
  misc_feature: GZ8MTXP01B2PF1.45.37.D04.1.454.CMB.2.raw
tcagacgcgatcgacacgaccggtgctcgatttagtagcatactgttgggtttgggggcatcacccagcaaccacatctgtcctctagagaatcccctgagagctccgttcctcaccatggactggacctgtaggatcctcttcttggtggcagcagccacaagagcccactccccaggtgcagctggtgcagtctgggggctgaggtgaggaagcctgggggcctcagtgaaggtctcctgcaaggcttctggctacaccttcaccggcgactatctccacgtggggtgcgacgacggccccctggacaaggggcttggagtggatgggatggatcaaaccctaacaatggtggcacaaaaactatgcacagtaagttcgaggggcagggtcacgatacgacgaggacacgtcatcagcacacgacctacgagtaggagcgtagacgcgaggacctggaacactccgtacggaaccgaacgaccggtcccttaagtttaacttaaccgttggttcggttacgggtaagggtacgttcgggttttaaccggggtgggttccgtttaacgggtttttccgtttttaacggg

SEQ ID NO: 348493 - DNA, 628 bp, Homo sapiens
  misc_feature: GZ8MTXP01D0Y9F.45.37.D04.1.454.CMB.2.raw
  modified_base (240)..(240): a, c, t, g, unknown or other
  misc_feature (240)..(240): n is a, c, g, or t
  modified_base (324)..(324): a, c, t, g, unknown or other
  misc_feature (324)..(324): n is a, c, g, or t
  modified_base (442)..(442): a, c, t, g, unknown or other
  misc_feature (442)..(442): n is a, c, g, or t
  modified_base (461)..(461): a, c, t, g, unknown or other
  misc_feature (461)..(461): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccacatcaactgcaagtccagccagagttgtttanacagctaccaaacaataagaactactagctaggtaccagacaagaaaccaggtcagcctactaagctacgctactaatttacgnggactacgtaccgtaacccgggacgtcccggggtccccctcgaccgtattccgaggtcgggcgaacgggtccgggtcgtacggggactaggtactttccaccttcacaccatccgaancgacgccgtagcgacggtnaagggaaatgtggggtacgggtctttaaggtttactgtaccgttgtacgaatactaaatttattaagtttactaacctttcccaccggtttacccgtttccggaccccgttagggaaacccgttaagttccggaatacgtaacgaaaacgtgttcggtggaacctcg

SEQ ID NO: 348494 - DNA, 574 bp, Homo sapiens
  misc_feature: GZ8MTXP01A61YJ.45.37.D04.1.454.CMB.2.raw
  modified_base (441)..(441): a, c, t, g, unknown or other
  misc_feature (441)..(441): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggagatcctcttcttggtggcagcagccacaagagcccactcccaggtgaagctggtgcagtctggggctgaggtgaggagccgtggggcctcagtgaaggtctcctgcaaggcttctggctacaccttcaccggcgactatctccactggtgcgacacggcccctggacaagggcttgagtggagtgggatggatacaacctaacaagtggtggacaacgaaaaactatgacaacgaagtaagtttccgaggggcacgggtacacgatgacgagggacacgtcatcagcacagcctacgagtgggacncgagacgacgagacgtcgactacgtcgacgaaccgtaccgacgtaccttaagtttacgttacgttggttcgttacggtaaggtacgtttcgggtttaccgggtcggttccggtttcggttttccgtttaacgg

SEQ ID NO: 348495 - DNA, 681 bp, Homo sapiens
  misc_feature: GZ8MTXP01DX0KR.45.37.D04.1.454.CMB.2.raw
  modified_base (255)..(255): a, c, t, g, unknown or other
  misc_feature (255)..(255): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcaggtcgtggggctggaggtgaggagccgtggggcctcgagtgaaggtctcctgcaaggcttcnggctacacctcgaccggcgactatcctccacgtgggtcgccgacgacggcccctgggaacgaagggtcttaggaggtggagtgggataggactaccaaacccccgtaacaagtggtacgaccaaaactaaaactgtacggaccaaacgtaacgtaacggtttcgggacggggtacgacgggtaccaaccgtagtacggaaccgacgggtaccaccgtaccagtaccgacgcaacgacgtacctaacgagtcggaacggtctgacgacaaacggtactacgaacgtacgttcggaaccggaaccgacggtaaccggttaccctttaaagttttacgttaaccggttggttcggtaaccgggttaagggttaacgtttacgggggtttaccggttcgggtttccgttttccgggttttttaacccggg

SEQ ID NO: 348496 - DNA, 619 bp, Homo sapiens
  misc_feature: GZ8MTXP01AJHMS.45.37.D04.1.454.CMB.2.raw
  modified_base (494)..(494): a, c, t, g, unknown or other
  misc_feature (494)..(494): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcgagtgaaggtctcctgcaggcttctggctacacctcaccggcgactatctccacgtgggtcgcgaccgacggcccccgtaggacgaagggctttggaggtggtagtgggattgggaatccgaaaaccccctaacgaagttggggtacggaccaaaaacgaaaacctgtcgaaccaactaaggtaaacgtttcgaacggggtacgacggggtaccaacccagtacggaacccgaggggtaccacgtccatcgagcacacgaccctanagtggaacgcgtgagcgaagacctagacagtcgaagaccgagacccgcgttaactttattccgttagttcggaacggtacggtgttcggtttaccggggttgttcggtttcgtttttaacccggg

SEQ ID NO: 348497 - DNA, 589 bp, Homo sapiens
  misc_feature: GZ8MTXP01DUEEX.45.37.D04.1.454.CMB.2.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (376)..(376): a, c, t, g, unknown or other
  misc_feature (376)..(376): n is a, c, g, or t
  modified_base (434)..(434): a, c, t, g, unknown or other
  misc_feature (434)..(434): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagacgcccactcccaggtgcagctggtgcagtctggggctgaggtgaggaagcgtgggcctnagtgaaggtctctgcaaggcttcnggctacacctcaccggcgactatctccacgtgggtcgcgacgacggccccgtggaaccgaagggcttggagtggagtgggatggactaccgaaaccccctaacaagtggtagacaaaacaaactntagacaacagtaacgttcgagggcagggtcaccagtacgaccgagggacacgtccaanacacgacacacgactaacgtagtcggacgcgtagacgacgtaacgactacgaactacgtacgtaacggaaccgaacgtaaccgttacttaaagtttacttacgttgttacgaacggtagttaacgttcgggttacggttgttcgtttcggtttcg

SEQ ID NO: 348498 - DNA, 631 bp, Homo sapiens
  misc_feature: GZ8MTXP01A1M59.45.37.D04.1.454.CMB.2.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
  modified_base (529)..(529): a, c, t, g, unknown or other
  misc_feature (529)..(529): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgnggggctggaggtgaggagccgtggggcctnagtgaggtctcctgcgaaggtcttcgtggctacaccttcgaccggcgactatctccacgtgggtcgcgacgcggcccctggaacgaagggtcttgaggtggagtgggatggactacccaaaccctaaagaagtggtacggaaccaaactaactagtacgacaacgtaggtaacggtttcgagggcgagggtaccacgtacgtcggaccgaacggggaccacggtaccaagccgaacggccaaccgacgggtacccttaagacgtacgggagcgtaggacgacgaacggtactacgaacncgttaacgacggaaccgaccgttaccggtaccttaagttttacgttacgttggtcgacggaaggttacgttcgggttaccggttggttccgtttttaacggg

SEQ ID NO: 348499 - DNA, 578 bp, Homo sapiens
  misc_feature: GZ8MTXP01DKLV4.45.37.D04.1.454.CMB.2.raw
  modified_base (227)..(227): a, c, t, g, unknown or other
  misc_feature (227)..(227): n is a, c, g, or t
  modified_base (445)..(445): a, c, t, g, unknown or other
  misc_feature (445)..(445): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagccccactccccaggtgcagctggtgcagtcgtggggctgaggtgaggagccgtggggcctnagtgaaggtctcctgcaaggcttctggctacaccttcaccggcgactactctccacgtggggtgcgacgacggcccccgtggacgaaggggtcttggagtgggatgggatggatcaaacctaacagtggtggacaacaaaactatgacaacgaagtaagttcgagggcagggtcacgatgacgagggacacgtcatcagcacacgccagagtgggaancgtagacgacagtactcggactatcgtacggaacgaacgaccggtaccttaagtttttacgtacttaggttcgacggtaagggttacgtttgggtttaaccggtggttcgtttcggttttccgttttaacggg

SEQ ID NO: 348500 - DNA, 587 bp, Homo sapiens
  misc_feature: GZ8MTXP01A8NQ1.45.37.D04.1.454.CMB.2.raw
  modified_base (357)..(357): a, c, t, g, unknown or other
  misc_feature (357)..(357): n is a, c, g, or t
  modified_base (380)..(380): a, c, t, g, unknown or other
  misc_feature (380)..(380): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagccgtggggcctcagtgaaggtctcctgcaaggcttcgtggctacacctcacccggcgactatctccacgtgggtgccgacgacggcccccgtggacaaggggcttggacgtggagtggggatggataccaaacccccctaanaagtggtaggacaaacgaaactntgacacagtagtttcgagggcagggtcaccagtcgaccgagggacacgtcacgtcacgcacgacgaccgtaacagtaggagtaccgtgacgacgaagtaccgtcgactacgtcgaacgacgaccgaccggttaccgtaattttacgttacgttgttaggtccgaggtcgttacggtttcccgggttggtccgtttgggtttttcccg

SEQ ID NO: 348501 - DNA, 543 bp, Homo sapiens
  misc_feature: GZ8MTXP01B4A1D.45.37.D04.1.454.CMB.2.raw
  modified_base (226)..(226): a, c, t, g, unknown or other
  misc_feature (226)..(226): n is a, c, g, or t
  modified_base (407)..(407): a, c, t, g, unknown or other
  misc_feature (407)..(407): n is a, c, g, or t
  modified_base (467)..(467): a, c, t, g, unknown or other
  misc_feature (467)..(467): n is a, c, g, or t
  modified_base (508)..(508): a, c, t, g, unknown or other
  misc_feature (508)..(508): n is a, c, g, or t
  modified_base (516)..(516): a, c, t, g, unknown or other
  misc_feature (516)..(516): n is a, c, g, or t
  modified_base (519)..(519): a, c, t, g, unknown or other
  misc_feature (519)..(519): n is a, c, g, or t
  modified_base (529)..(529): a, c, t, g, unknown or other
  misc_feature (529)..(529): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcgtggggcctnagtgaaggtctctgcaaggcttctggctacacctcgaccggcgactatcctccacgtgggtgcgacacggccccctggacaaggcttgagtggatgggatggactacaaaccccctaacaagtggtagacaaacgaaactaatcgacacaagaagtttcgaagggcaagggtcaaccgaancggaaccgaggggaaccaccggtaccatcaacgccaacgacgcccttaagagtggaagcngagcaagactagacatcaagacacgacgacctattattcgngttgaagngtntcggttacgngtcgttggtttccg

SEQ ID NO: 348502 - DNA, 528 bp, Homo sapiens
  misc_feature: GZ8MTXP01CMPHI.45.37.D04.1.454.CMB.2.raw
  modified_base (251)..(251): a, c, t, g, unknown or other
  misc_feature (251)..(251): n is a, c, g, or t
  modified_base (258)..(258): a, c, t, g, unknown or other
  misc_feature (258)..(258): n is a, c, g, or t
  modified_base (429)..(429): a, c, t, g, unknown or other
  misc_feature (429)..(429): n is a, c, g, or t
  modified_base (445)..(445): a, c, t, g, unknown or other
  misc_feature (445)..(445): n is a, c, g, or t
  modified_base (448)..(448): a, c, t, g, unknown or other
  misc_feature (448)..(448): n is a, c, g, or t
  modified_base (456)..(456): a, c, t, g, unknown or other
  misc_feature (456)..(456): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttcnggctacncctcaccggcgactatccccactgggtgcgacacggcccctggacaagggcttgagtggatgggatggatcaacctaacaatggtggacacaaaactatgacaacagtaagttcgaggggtcaggggtcacatcgacgaggacacgtcatcagcacagcctacgagtggancgtgagcagactgacntcngaacgacncggcttagtttactacgttgttgcgaaggtagttcggtttaccggtgttcgttcggtttccgttttaacggg

SEQ ID NO: 348503 - DNA, 577 bp, Homo sapiens
  misc_feature: GZ8MTXP01CBQA8.45.37.D04.1.454.CMB.2.raw
  modified_base (240)..(240): a, c, t, g, unknown or other
  misc_feature (240)..(240): n is a, c, g, or t
  modified_base (349)..(349): a, c, t, g, unknown or other
  misc_feature (349)..(349): n is a, c, g, or t
  modified_base (371)..(371): a, c, t, g, unknown or other
  misc_feature (371)..(371): n is a, c, g, or t
  modified_base (424)..(424): a, c, t, g, unknown or other
  misc_feature (424)..(424): n is a, c, g, or t
  modified_base (440)..(440): a, c, t, g, unknown or other
  misc_feature (440)..(440): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtgggcctgagtgaaggtctcngcaggcttctggctacacctcaccggcgactatcctccacgtgggtgcgacgacggcccctgggacaagggcttggagtggagtgggatggataccgaaaccccctaanaagtggtaggacaaacaaactntcgacaacgagtaagttcgagggcagggtcacgagtcgacgaggacacgtcancagcacacgaccgtanagtggacgcgtagacgcgagactagactagtcgtaacgacgaacgaccggttacttaagtttacttacgttggttaggaaccggtaggtaacgtttcggtttaccgggttggttaaccgtttcggtttttaacccgg

SEQ ID NO: 348504 - DNA, 646 bp, Homo sapiens
  misc_feature: GZ8MTXP01CRSDH.45.37.D04.1.454.CMB.2.raw
  modified_base (358)..(358): a, c, t, g, unknown or other
  misc_feature (358)..(358): n is a, c, g, or t
  modified_base (415)..(415): a, c, t, g, unknown or other
  misc_feature (415)..(415): n is a, c, g, or t
  modified_base (430)..(430): a, c, t, g, unknown or other
  misc_feature (430)..(430): n is a, c, g, or t
  modified_base (465)..(465): a, c, t, g, unknown or other
  misc_feature (465)..(465): n is a, c, g, or t
  modified_base (470)..(470): a, c, t, g, unknown or other
  misc_feature (470)..(470): n is a, c, g, or t
  modified_base (477)..(477): a, c, t, g, unknown or other
  misc_feature (477)..(477): n is a, c, g, or t
  modified_base (511)..(511): a, c, t, g, unknown or other
  misc_feature (511)..(511): n is a, c, g, or t
tcagacgcgatcgacacgaccggtgctcgatttagtagcatactgttggggtttgggggagctacaacaggcaggcagggggcagcaagatggtgttgcagacccaggtcttcatttctctgttgctctggatctctggtgccgtacggggacatcgtgatcgacccagtctccagacctccctggctgtgtctcgtgggcgagacgggccaccatcaactgacaagtccagccagtagttgtttagacagctaccaaactaaataacgtaaacttactagcgttacggtaaccaagacgaaacgaaaccgaggtaccaacgccctaccgtaaagcctacgaccttactatttaccgngggacctacgtacccggtaacccggggacgttccccggggtacccctacggaccgtnttccgaggtcggcgngggcgggtcgagggactagtcttcactcacactancagcngtaccgngacgagacaagaagtgtggggtacgtattagttncgtctgtataagtacttaattacttaattaccgttccttcccgttacggttacccgttccggtaacccggtaaggttaaaccgttaggttacgtaaactacgtaacgaaacggttcgttcggtcgttaaccgtcg

SEQ ID NO: 348505 - DNA, 538 bp, Homo sapiens
  misc_feature: GZ8MTXP01BRCTC.45.37.D04.1.454.CMB.2.raw
  modified_base (469)..(469): a, c, t, g, unknown or other
  misc_feature (469)..(469): n is a, c, g, or t
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagccccactcccaggtgcagctggtgcagtctgggggctgaggtgaggaagcctgggggcctcagtgaaggtctcctgcaaggcttctggctacaccttcaccggcgactatctccactggggtgcgacacggccccctggacaaggggcttgagtggatgggatggatcaaaccctaaccaatggtggacaacaaaaactatgacaacagtaagtttcgaggggcagggtcacgatgaccgaggacacgtcatcagcacagcctacgagtggagctgacgcagactgacatctggaacgacncggtacttagtttattacttgngcgaaggtnttggtttaccggtggttcgttcggtttcgttttaacgg

SEQ ID NO: 348506 - DNA, 693 bp, Homo sapiens
  misc_feature: GZ8MTXP01CAH1N.45.37.D04.1.454.CMB.2.raw
  modified_base (253)..(253): a, c, t, g, unknown or other
  misc_feature (253)..(253): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcaggcttcnggctacacctcgaccggcgactactctccacgtgggtcgcgacgacggcccctggacgaagggcttggagtggagtgggatggactaccgaaacccccctaacgaagtgggtacgaccaaaacaaacctgtcgaccaacgtaagtaacgtttcgaggggccaggggtaccaccgtagtcgaaccgaggggaccaccggtaccacgtacgacgaccaacgacggacccttaacgagtacgggaacgtcgtacggaacgacgaacggacccttagggaacctaacgtccggttaacggaaacccggttaaccggtaacccgggttaccgttaaactttttacgtttaaaccggttggttaccggtaaccgggtaaggttaacggtttaccgggttttaaccggggttcggttcccggttttcggggtttttttaaccccggg

SEQ ID NO: 348507 - DNA, 739 bp, Homo sapiens
  misc_feature: GZ8MTXP01C8JKD.45.37.D04.1.454.CMB.2.raw
  modified_base (253)..(253): a, c, t, g, unknown or other
  misc_feature (253)..(253): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcaggcttcnggctacacctcaccggcgactatcctccacgtgggtcgccgacgacggcccccgtagggaccgaaaggggtccttaggacggttggggaagtgggggtaatcggggtaactacccgaaaaccccccgttaaacaaagttcggggtaggacccaaaaacgtaaaactgtacggactaaacgaaggtaaacgtttcggaaggggtaccgaaggggttaccaaccgtacgtacggaaacccgaacggggaaccgtaaccggtacctaacgaccgaaaggacccaaaccgacggtaacccctaaaccggtaagttacgggacggtaccgttaaggacgaccgaagggtaactcggaaactacgtaccgtaacgaaaccgaccgtaaaccggttcctttaagtttaactttaccggttggttaccggtgtaacggggttaagtttacggggtttaccgggttcgggtccggttttcgggtttttaacccgg

SEQ ID NO: 348508 - DNA, 525 bp, Homo sapiens
  misc_feature: GZ8MTXP01CEQDR.45.37.D04.1.454.CMB.2.raw
  modified_base (425)..(425): a, c, t, g, unknown or other
  misc_feature (425)..(425): n is a, c, g, or t
  modified_base (441)..(441): a, c, t, g, unknown or other
  misc_feature (441)..(441): n is a, c, g, or t
  modified_base (458)..(458): a, c, t, g, unknown or other
  misc_feature (458)..(458): n is a, c, g, or t
  modified_base (461)..(461): a, c, t, g, unknown or other
  misc_feature (461)..(461): n is a, c, g, or t
  modified_base (483)..(483): a, c, t, g, unknown or other
  misc_feature (483)..(483): n is a, c, g, or t
  modified_base (494)..(494): a, c, t, g, unknown or other
  misc_feature (494)..(494): n is a, c, g, or t
  modified_base (505)..(505): a, c, t, g, unknown or other
  misc_feature (505)..(505): n is a, c, g, or t
tcagacgcgatcgacacgaccggtgctcgatttagtagcatactgttggggtttgggggcatcacccagcaaccacatctgtcctctagagaatcccctgagagctccgttcctcaccatggactggacctggaggatcctcttcttggtggcagcagccacaagagccccactcccaggtgcagctggtgcagtctggggctgaggtgaggaagccgtggggcctcagtgaaggtctcctgcaaggcttctggctacaccttcgaccggcgactatctccactggggtgcgacacgggccccctggacaaggggcttggagtggatggggatggatcaaacctaacaagtggtgcacaaaactatgcaacgagtaagttcgaggggcagggtcaccgatgaccgagggacacgtccatcagcanagacctacgagtggancgtgagctagactgacntcngaacgacgacgcttatttatcngttgcgtaagnttcgttacggngttcttggtttcgtttaagg

SEQ ID NO: 348509 - DNA, 622 bp, Homo sapiens
  misc_feature: GZ8MTXP01DKRLK.45.37.D04.1.454.CMB.2.raw
  modified_base (254)..(254): a, c, t, g, unknown or other
  misc_feature (254)..(254): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtgggcctgagtgaaggtctctgacaggcttcgnggctacacctcaccggcgactatctccactgggtgcgacacggccccgtggacgaagggtcttggagtggagtgggatggactacccaaaccctaagagtggtaggaacaactaactatacgaccaacaggtaaacgtttcgaagggtcgtaaggggtaccaacgtagtacggaacccgaacgggtaccaccgtaccaagtacgacggacaaccgacgggaccctaacgtaagtagggaagccgtaggacggacacggtacgtacgaacctgtaaccgtacggaccgaaacgaccggtaccctagttttaagttaccgttggttcgaggtaacgtacgttggttaccggtcggttaacgttttccggg

SEQ ID NO: 348510 - DNA, 510 bp, Homo sapiens
  misc_feature: GZ8MTXP01B7J1H.45.37.D04.1.454.CMB.2.raw
  modified_base (227)..(227): a, c, t, g, unknown or other
  misc_feature (227)..(227): n is a, c, g, or t
  modified_base (343)..(343): a, c, t, g, unknown or other
  misc_feature (343)..(343): n is a, c, g, or t
  modified_base (388)..(388): a, c, t, g, unknown or other
  misc_feature (388)..(388): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagctggggcctnagtgaaggtctcctgcaaggcttctggctacaccttcaccggcgactatctccactgggtgcgacacggcccctggacaagggctttgagtggagtgggatggatcccaacctaanaagtgtggacaacaactatgacacagaagttcaggcaggtcacangaccaggacacgccaancanacacacgtacagagagangngagacacgtacacgacatctcgacgacgacgtactacttagttcgttgtgagtaagtagtcggttacggttcggttcgttcg

SEQ ID NO: 348511 - DNA, 596 bp, Homo sapiens
  misc_feature: GZ8MTXP01EU67B.45.37.D04.1.454.CMB.2.raw
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (351)..(351): a, c, t, g, unknown or other
  misc_feature (351)..(351): n is a, c, g, or t
  modified_base (375)..(375): a, c, t, g, unknown or other
  misc_feature (375)..(375): n is a, c, g, or t
  modified_base (440)..(440): a, c, t, g, unknown or other
  misc_feature (440)..(440): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggagatcctcttcttggtggcagcagccacaagacgcccactcccaggtgcagctggtgcagtcgtgggctgaggtgaggagccgtgggcctgagtgagtcnctgcagtctcngctacacctcaccggcactatctccgacgtgggtcgcgacgaccggtccccgtggaacgacgggtcttggaggtgggagtgggataggactacccaaccctaanagtcggtacgaacaaacaacttanagacaactaaggtaacgttcgagggcacggtccacgagtcggaaaccgagggaacctacgtacanacgacgacctaacgcggtactaacgagtacggagtcaggacgacgacgtacggtacaaactgtaacacggaaccgaccgttacgtaccttaagtttagttccgttaggaaggcgtaaggttacgttcggttacgggtcgtttggtttttaacccgg

SEQ ID NO: 348512 - DNA, 680 bp, Homo sapiens
  misc_feature: GZ8MTXP01B2SMJ.45.37.D04.1.454.CMB.2.raw
  modified_base (227)..(227): a, c, t, g, unknown or other
  misc_feature (227)..(227): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctnagtgaaggtctcctgcaaggcttctggctacacctcgaccggcgactatctccacgtgggtgcgacacggcccccgtggacgaagggtcttggaggtggagtgggatggactaccaaaccccctaacaaagtgggtacggacaaaaccgtaaactgtacgacctaacgaaggtaaaggtttacgaagggggtacgaacggggttaccaacccgtaagtacggaaacccggaacggggaaccaccggttaccaacgtacgaacgccaacgaaccggacctaaaccgtacgttagggaacgtcgtacgacgacgaacggacctaggaacctaacgttccgtaacggaaccgaacccgtaaccggttacccgttaaagttttaactttaacgttggttacggaaggtacggtaagtttcgggttaccgggttggtcggttttcggttttaacccgg

SEQ ID NO: 348513 - DNA, 619 bp, Homo sapiens
  misc_feature: GZ8MTXP01AQ2V8.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctcctgcaaggcttctggctacacctcaccggcgactatctccacgtgggtgcgacgacggcccctggacagggcttgagtggatgggatggatccgaaaccccctacaagtggtggacaaacaaactgtgacaacgagtaagttcgagggtcgacgggtcacctagtacggaccgtagggaccacgtaccagtcagcacacgaccgtacagtgggacgcgtaggacgacaggtactacggaacaccgtacgtaacggaaccggaccgaccggttccttaaacgttttaacgttaacgttgggttcggtaacgggtaagggttaacggtttacgggtttacccggggttgggtttccggtttccggggttttttaacccggg

SEQ ID NO: 348514 - DNA, 629 bp, Homo sapiens
  misc_feature: GZ8MTXP01DQNQG.45.37.D04.1.454.CMB.2.raw
  modified_base (382)..(382): a, c, t, g, unknown or other
  misc_feature (382)..(382): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcaggtcgtggggctggaggtgaggagccgtggggcctcgagtgaaggtctctgcaagcttctggctacacctcaccggcgactatctccacgtgggtcgcggacacggcccctggacgaagggtcttggaggtggagtggggatgggataccgaaaccccctaacaaagtgggtacgacaaaaccaaactntgacaacaaggtaacgtttacgaggggacacggggtacaacccagtacgaccgaaggggaccacggttaccataccgagacaacgacggacctaacgagtacggagcctaggacgccgaagacgtgacacgttcaaggaaccgacgtaaccggttaccttaagttttaacgttacgttggttagtcgggtaaggttaacgtttcgggtttacccggggttgttcgggtttaacggtttttttcccgg

SEQ ID NO: 348515 - DNA, 796 bp, Homo sapiens
  misc_feature: GZ8MTXP01DV531.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagaggccacatcaactgcaagtccagccagagttgtttagacagctaccaaacaaataagaactactagcttaggtaaccagacaaacgaaaccaggtacaagaccctacctaagcctgactactactttacgtgggactacttaccgtaaccccggggaacgttccccggggtccccctacggtaccgtagttcccgaaggttcgggacctaacggggtccggggtacgtacgggggaactaacggtacttttaccaacccttactacccaaccctagtaccaacggtaccgaaccggtcccgttaggacccgaaggggtaccgttaagggaaaaacggtacggttcggggttaggggttacctttaaacgggttttaattggtccttagggtacctaaaaggtaccttaaaatttaaacttttaattttaaaccgttaacccttttaacccccgttcccggggtttaaacccgttttcccggggtaacccccgtttaaggggggttaaaaccccgttaaaaaggtttacgggtaaacttaaaacttaaaccccgtaaaaaggtaaacccggttgggttaacgggaaacccttccgg

SEQ ID NO: 348516 - DNA, 751 bp, Homo sapiens
  misc_feature: GZ8MTXP01B9KVU.45.37.D04.1.454.CMB.2.raw
  modified_base (243)..(243): a, c, t, g, unknown or other
  misc_feature (243)..(243): n is a, c, g, or t
  modified_base (274)..(274): a, c, t, g, unknown or other
  misc_feature (274)..(274): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggagatcctcttcttggtggcagcagccacaagagcccactcccaggtgcagctggtgcagtctggggctgaggtgaggaagcgtggggcctgagtgagtctctgcagctngctacactcacgcgactatcctcacgtggtncgacgacggcccctggacaaggtctgagtggagtggatggataccgtaaacccccgtaaagaagtcggtacggaccaaaacgtaaaacctaagttacgaacgtaactaaacggtaaacgggtttacccgaaaggggtaccgaacggggttacctaaacccgtaacgtaccgggaaacccggaaacgggggtaaaccaacccgggttacccaacgttaccccggaaaggaccctaaccgaacggtaccccttaaacgtaggtaacgggtacgacgttacggaacgtacgaaacggttaccggtaacgaaactaaccgttccgtaaccggtaaacccgttaaacccggacccgggttaacctttaaacccgtttttaaagttaacccggttcgttaagggtcggtaaaacgggtttcgtttacccgggttttaaccgggttcgggtttaaccggttttaaccgggtttttttccccggg

SEQ ID NO: 348517 - DNA, 587 bp, Homo sapiens
  misc_feature: GZ8MTXP01B01D3.45.37.D04.1.454.CMB.2.raw
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (462)..(462): a, c, t, g, unknown or other
  misc_feature (462)..(462): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaagcgtgggcctnagtgagtctcngacagctcngctacactcncgcactatctcagtggngcgcncggccctggacaggtctgagtggagtggatggactaccgaaaccccctaagagtggtcgacaaaacgaaacttgagacacgtagtaacgttacggacgggtactacggggtacaacgtagtacggacgagggaccacggtcaagtcacgacaacgcgactacgaggtcgacgacgtgacganacgactcgaactcgtcgaacgaacgcgtaacgttcctttaaagtttacgttaccgttgggttaggtaacggttacggtcgttttaccgggttacggttcgggtttcgttttaacgggttttccgg

SEQ ID NO: 348518 - DNA, 590 bp, Homo sapiens
  misc_feature: GZ8MTXP01D56YX.45.37.D04.1.454.CMB.2.raw
  modified_base (372)..(372): a, c, t, g, unknown or other
  misc_feature (372)..(372): n is a, c, g, or t
tcagacgcgatcgacacgaccggtgctcgatttagtagcatactgttggggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtgggggctgaggtgaggaagcctgggggcctcagtgaaggtctcctgcaaggcttctggctacaccttcaccggcgactactctccacgtggggtgcgacacggccccctgggacaagggcttggagtggatggggatggatcaaaccctaacaagtggtaggacaacaaaaactntcgacaacgagtaagtttcgagggcagggtcacatgacgaggacacgtcatcagcacgacgacctaacgagtggaagtcgagacgcgaagtactggaactactcgtacggaaccgaacgaccgggtaccttaattttacgttaacgttggttcggttacggtaaggtacgttcggtttaaccgggtggttccgtttcgggttttccgtttttaacggg

SEQ ID NO: 348519 - DNA, 558 bp, Homo sapiens
  misc_feature: GZ8MTXP01B33O1.45.37.D04.1.454.CMB.2.raw
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
  modified_base (405)..(405): a, c, t, g, unknown or other
  misc_feature (405)..(405): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcagtgaaggtctctgcagctcnggctacnccttcaccggcgactatctccatgggtgcgacacggcccctggacgagggcttggaggtggagtgggatggactacccaacctagagtggtagacaacaactatgacacagtaagttcgagggtcagggtcacgagtcgacgagggacncgtccatcagacacgacggactactaagtggagtcgtgacgcgacgtactacggacatcgtcgaaccggtaaccacgggtacctattttacttcgttacggtgtacgggtaaggttacgtttcgggtttaccgggtcggtttcgttttcgggg

SEQ ID NO: 348520 - DNA, 587 bp, Homo sapiens
  misc_feature: GZ8MTXP01AT616.45.37.D04.1.454.CMB.2.raw
  modified_base (365)..(365): a, c, t, g, unknown or other
  misc_feature (365)..(365): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacacctcaccggcactatctccactgggtcgcgacacggcccctggacaagggccttggagtggagtgggatggatcaaccccctaacaagtggtaggcaaacaaactntgcacagtaagtttcgagggacgagggtacaccagtacgaccgagggtacgacgtccagtcacgcacacgccgtacagtggaacgtcgagacgcgaagaccctagaccctaagtcgtaagaacgttaaccgacgggttacctaacttttaagttaccgttggttcgcggtaaggtcgttaggtttacccggggttggttaaccggtttcggtttttcccggg

SEQ ID NO: 348521 - DNA, 686 bp, Homo sapiens
  misc_feature: GZ8MTXP01CY0IB.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacacctcaccggcgactatctccacgtgggtgcgacaggcccctgaacaagggcttgagtggagtggatggatacaaacccccctaacgaaagtgggtaggacaaaaccaaactaagtagacaaacgtaagtaacggtttacgaagggggtcgacggggtacaaccgaagtacggaacccgacgggggaaccaccggttaccaactcgaacgccaacaacgacccttaacgagttagggaacgtcgtaggagaccgaaggaactcggaactacgtcgtaacgggaaaccgaacccggtaaccgggttacccgtttaaaatttttacgtttaaacccgttgggttacgggtaaccgggtaaggggttaacgttttcggggtttttaacccgggggttcggggtttaaccgttttcggggtttttttccccgg

SEQ ID NO: 348522 - DNA, 591 bp, Homo sapiens
  misc_feature: GZ8MTXP01ERNSN.45.37.D04.1.454.CMB.2.raw
  modified_base (448)..(448): a, c, t, g, unknown or other
  misc_feature (448)..(448): n is a, c, g, or t
  modified_base (480)..(480): a, c, t, g, unknown or other
  misc_feature (480)..(480): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcaggcttctggctacacctcaccggcgactatcctccacgtgggtgcgacgacggcccctggacaagggtcttggagtggagtgggatggataccgaaaccccctaagaagtggtggaccaaaacgaaactgtgacaacgagtaagtttcgagggtcagggtcaccatcgacgaggacacgtacatcgagcacacgacctaanagtaggagccgagacgacgaacgactagaacncttcgaacggaaccgacgaacccggttacttaacgttttaattaaccgttgttcggaacggtaggtaacgtttcggtttaccgggttggtcgttttcggtttttaacccgg

SEQ ID NO: 348523 - DNA, 675 bp, Homo sapiens
  misc_feature: GZ8MTXP01CYD0C.45.37.D04.1.454.CMB.2.raw
  modified_base (226)..(226): a, c, t, g, unknown or other
  misc_feature (226)..(226): n is a, c, g, or t
  modified_base (237)..(237): a, c, t, g, unknown or other
  misc_feature (237)..(237): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctnagtgaaggtcnctgcaggctctggctacacctcaccggcgactatctccacgtgggtcgcgacgacggcccctggacgaagggcttggaggtggagtgggatggataccaaaccccctaagaaagtgggtacggaccaaaacgaaaactgtacgaccgaaacgtaaggtaagtttacggaggggacgtacggggtaccaaccgagtacggaaccgaacggggaaccacgggttaccaacgtacaacggaccaacgaaccgacccgttaacgacggttagggaacggtacgtggaacgacaacggtaaccgtagaacgtactacggtaaccgaaacggaccgtaccggacctttaaagtttacgtttaacgttggttacggtaacgggtaacggttaacggtttcgggtttaccgggttacgggttccgttttcgggttttttaacccgg

SEQ ID NO: 348524 - DNA, 639 bp, Homo sapiens
  misc_feature: GZ8MTXP01AJWA5.45.37.D04.1.454.CMB.2.raw
tcagacgcgatcgacacgaccggtgctcgattttagtagcatactgttgggtttgggggcatcacccagcaaccacatctgtcctctagagaatcccctgagagctccgttcctcaccatggactggacctggaggatcctcttcttggtggcagcagccacaagagccccactcccaggtgcagctggtgcagtctgggggctgaggtgaggagccgtggggcctcgagtgaaggtctccgtgcgaaggtcttcgtcggctactacccgttcaccggcgtactatcctccacgtggtgacgacgacggcccctggacgagggtcttggagtgggagtcgggatggactaccgaaacccgtaaccaagtgggtacggaccaaacgtaaaaacgtatcgaccaaacgtagtaaacggtttcgacggggtacacggggtaccaccgagtcgaaccgagggacacgtccatacacgcaacgacgacctaacggagtacgggaacgtcgtaggacgacgaacggaactacgactacgtacgacggaacccacgaacgtacccttagtttaacgttacgttggttcgacggtaagggtcgttaacgggttacggtcggttccgtttcggttttcgtttaacggg

SEQ ID NO: 348525 - DNA, 606 bp, Homo sapiens
  misc_feature: GZ8MTXP01DBTCL.45.37.D04.1.454.CMB.2.raw
  modified_base (145)..(145): a, c, t, g, unknown or other
  misc_feature (145)..(145): n is a, c, g, or t
  modified_base (203)..(203): a, c, t, g, unknown or other
  misc_feature (203)..(203): n is a, c, g, or t
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
  modified_base (448)..(448): a, c, t, g, unknown or other
  misc_feature (448)..(448): n is a, c, g, or t
  modified_base (460)..(460): a, c, t, g, unknown or other
  misc_feature (460)..(460): n is a, c, g, or t
  modified_base (558)..(558): a, c, t, g, unknown or other
  misc_feature (558)..(558): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctnttcttggtggcagcagccacaagagcccactcccaggtgcagctggtgcaggtccggngngaggnggaggaagcgtcgggcgtcagtaggaggtacgtctgcgaagcgttctggctacacctccacggcgactactctccacgtgggtgcgacgacgccccgtggaacgaaggcgttggagtggaggtggagtaggataccaaaccccctaaactaagtgggtacggacaaaaccaaaataagtgcctaaacgaagtaaacgttcgaggggacgaggtacaccaagtcgaaccgaacgggaanacctccgaacanacgacaacgacgtactaaaccgtaggtacgaggtctacgaggcaaacgtactagcaattcgcggaaacgacgtacgacctttaaatttacgtttacgnggttaggcgtaggttgtttcggttcgggttcgttcgttcggttttccg

SEQ ID NO: 348526 - DNA, 595 bp, Homo sapiens
  misc_feature: GZ8MTXP01CQYWT.45.37.D04.1.454.CMB.2.raw
  modified_base (247)..(247): a, c, t, g, unknown or other
  misc_feature (247)..(247): n is a, c, g, or t
  modified_base (494)..(494): a, c, t, g, unknown or other
  misc_feature (494)..(494): n is a, c, g, or t
  modified_base (540)..(540): a, c, t, g, unknown or other
  misc_feature (540)..(540): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggactggaggatcctcttcttggtggcagcagccacaagagcccactcccaggtgcagctggtgcagtcgtggggctgaggtgaggagcgtgggcctgagtgaggtctctgcaggcttcgnggctacacctcgaccggcgactatctccacgtgggtgacgacgacggcccagtcggaacgaagggtcttagggaggtgggagtgggggaatcgggaactaaccccgtaaacccctaaagtaagtagggtacggaaaccaaacaacgttatacggacaaacgaggtaacgtttcgagggtacagggtaccacgatcgaaccgagggacacgtccatacagacaacgagcccgtagagtggagcagganacgagacctgactatcgtagaccacgacgtacctaattttacgttnttaggttggacggtaagttagttccgggtttacggttcggttaacgttttccggg

SEQ ID NO: 348527 - DNA, 596 bp, Homo sapiens
  misc_feature: GZ8MTXP01CTAX5.45.37.D04.1.454.CMB.2.raw
  modified_base (291)..(291): a, c, t, g, unknown or other
  misc_feature (291)..(291): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagccgtggggcctcagtgaaggtctctgcagctctggctacacctcgaccggcgactatctccacgtgggtgcgacncggcccctggaacgaagggcttggagtggagtggatggataccaaaccccctaacaagtggtaggacaaacaaactaatcgacaacgaagtagtttacgaggggcgagggtcaaccagtacgaaccgagggacaccggtccatcgagacacacgcctacgagtggacgcgtagacgacgaacgactacggacctagtccgtaacgaaccgacgtaccgggacctttaaagtttacgttaacgttggttacgaacggtaaggtctttacgggtttacgggttgttccgttttaaggtttttcccgg

SEQ ID NO: 348528 - DNA, 608 bp, Homo sapiens
  misc_feature: GZ8MTXP01ETC6X.45.37.D04.1.454.CMB.2.raw
  modified_base (297)..(297): a, c, t, g, unknown or other
  misc_feature (297)..(297): n is a, c, g, or t
  modified_base (354)..(354): a, c, t, g, unknown or other
  misc_feature (354)..(354): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcaaggcttcgtggctacacctcaccggcgactatctccacgtgggtgcgacncggcccctggacaagggtcttggagtggagtgggatggactaccaaacccccgtaanagtgggtcgaccaaaacaaactgtcgacacaggtaacgtttcgaggggcgagggtacaccgtagtcgaccgagggacacggtcagtcagcacgacgacctacgagtggagcgtgacgtcgaacgactacgaactctcgaacgtaacgaaccgtaccggttaccttaagttttaacgttaccgttggttacggtaacggtaaggttcgtttacgggtttaccgggttcggttccgttttcgggtttttaacccgg

SEQ ID NO: 348529 - DNA, 612 bp, Homo sapiens
  misc_feature: GZ8MTXP01BM0SN.45.37.D04.1.454.CMB.2.raw
  modified_base (243)..(243): a, c, t, g, unknown or other
  misc_feature (243)..(243): n is a, c, g, or t
  modified_base (341)..(341): a, c, t, g, unknown or other
  misc_feature (341)..(341): n is a, c, g, or t
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagccccactcccaggtgcagctggtgcagtcgtggggctgaggtgaggagcgtgggcctgagtgagtctctgcagctngctacacctcacggcgactatctccacgtgggtgcgaccgacggccccctggacgaagggtcttggaggtggagtgggatggactacgaaaccctaanagtggtacggacaactaaaaactagtgacaacgtaagtaacgtttcgacggggacgtacgggtaccaaccgtagtacgaccgaagggaacctacggtacccagtacacgaccaacgacgtaccctaagagtggacgcgtagacgacaaggacctacgaactagtcgtacggaaccgtacgaccgggtaccttaagtttaacgtacgttggttcgacggtaaggtagtttcggttacgggtcgttaccgtttcggttttcgtttaaccgggg

SEQ ID NO: 348530 - DNA, 792 bp, Homo sapiens
  misc_feature: GZ8MTXP01EJUJD.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgaccagtctccagacctccctggctgtgtctcgtgggcgagacgggccaccatcaactgacaagtccagccagtagttgtttagacagctacaaacaataagaactactagcttacggtaccagacaacgaaaccgaggtacacgcctacctaagctgctactatttacgtgggactacgtaccgtaacccggggtaacgtccccgggggtaccccctcggaaccgtattccgacggtacgggacgtaacgggtccgggtacgtacgggggaacctacggttactttaccaaccttcctacccaacctactaccgaacgtaccgaaccggtcccgtaggacccgaagggaccgttaaggaaaacgtaggtttgggggtacgggtaccgtttaaagtttttaacgttggtaccgtttcgggttaaccaaagggttaaccttaaaagttttaacgttttaaagttttaaccgtttaaacccttttccccgtttaccccggttaacccggttttttaccccggggaacccccggtttaaacgggggttaaaccccgttaaaagggttaccgggttaaattaaacttaacccggtaaaaaccggtaaccgtttggggtaacgggttcccgttaacccg

SEQ ID NO: 348531 - DNA, 561 bp, Homo sapiens
  misc_feature: GZ8MTXP01BPA78.45.37.D04.1.454.CMB.2.raw
  modified_base (253)..(253): a, c, t, g, unknown or other
  misc_feature (253)..(253): n is a, c, g, or t
  modified_base (362)..(362): a, c, t, g, unknown or other
  misc_feature (362)..(362): n is a, c, g, or t
  modified_base (429)..(429): a, c, t, g, unknown or other
  misc_feature (429)..(429): n is a, c, g, or t
  modified_base (440)..(440): a, c, t, g, unknown or other
  misc_feature (440)..(440): n is a, c, g, or t
  modified_base (464)..(464): a, c, t, g, unknown or other
  misc_feature (464)..(464): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcagtgaaggtctcctgcaaggcttcnggctacacctcaccggcgactatctccacgtgggtgcgacacggcccctggacaagggcttgagtggatggatggatacaaaccccctaagaatggtgcaaacaaactntgacacagtaacgtttcgagggcagggtcacatacgaccagggacacgtcatcagcacagaccctanagtcggagtcngacgcgaacgactagaccattcgngaacgacaacggttcctaaagtttacttaacgttgttacgaacgtaaggtaacgtttcgggttacccggttgggtccgtttaacggttttttcccgg

SEQ ID NO: 348532 - DNA, 604 bp, Homo sapiens
  misc_feature: GZ8MTXP01EGZJX.45.37.D04.1.454.CMB.2.raw
  modified_base (293)..(293): a, c, t, g, unknown or other
  misc_feature (293)..(293): n is a, c, g, or t
  modified_base (549)..(549): a, c, t, g, unknown or other
  misc_feature (549)..(549): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtggggcctgagtgaaggtctcctgcaaggtcttctggctacacctcaccggcgactactcctccacgtgggtncgacgacggccccgtggaccgaagggcttaggaggtggagtgggatggactaccaaaccccctaacagtgggtgaccaaaacgtaaactgcgacaacgaagtaagttcgacggggtcagggtaccaacgagtacgaaccgagggaccacggtaccataccgacgacaacgacgacctacaggtggagcgtagacgacgaagccgtaggactacgtccaagaccgaacgaccggttactaacttttaacttcgttgngtaacggtagtaacgtttcgggttaccggttggttccgttttcggtttttcccgg

SEQ ID NO: 348533 - DNA, 535 bp, Homo sapiens
  misc_feature: GZ8MTXP01DT6A3.45.37.D04.1.454.CMB.2.raw
  modified_base (360)..(360): a, c, t, g, unknown or other
  misc_feature (360)..(360): n is a, c, g, or t
  modified_base (432)..(432): a, c, t, g, unknown or other
  misc_feature (432)..(432): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctggggcctcagtgaaggtctctgcaagcttctggctacacctcaccggcgactatctccactgggtgcgacaggccccctggacaagggcttggagtggatgggatggatcaaacccccaacaaatggtggcaaacaaactntgacaacaagtaacgtttcgagggcagggtcacatgacagggacacgtacatcacgcaacacggcctaacgntaggagctgagcaagacctgacatctggacgaccacggcctaattttattaacttgttacgcgtaaggcttggtttaccggttgggttcgttgggtttttccg

SEQ ID NO: 348534 - DNA, 608 bp, Homo sapiens
  misc_feature: GZ8MTXP01C5H4R.45.37.D04.1.454.CMB.2.raw
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
  modified_base (342)..(342): a, c, t, g, unknown or other
  misc_feature (342)..(342): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtgggcctnagtgagtctctgcagcttcnggctacacctcaccggcgactatctccacgtgggtgcgacgacggccccgtggacaagggcttggagtggagtgggatggataccaaaccccctanaagtggtacgacaaaaccaaactgtgacaagtaagtaagttcgaggggccgagggtccaacgagtacgaccgagggacacgtacagtcgagcacacgacctaacagtaggacgcgtagacggcaaacggtactacgtaacacgttcgtaacggaacccgaacgaccggttacccttaaattttaacgttacgttggttacggaaccggtaagggtaacgtttaccgggttacggttcgggtttaaccgtttcgggtttttaacccg

SEQ ID NO: 348535 - DNA, 559 bp, Homo sapiens
  misc_feature: GZ8MTXP01D9RCQ.45.37.D04.1.454.CMB.2.raw
tcagacgcgatcgacacgaccggtgctcgattttagtagcatactgttggggtttgggggcatcacccagcaaccacatctgtcctctagagaatccccctgagagctccgttcctcaccatggactggacctggaggatcctcttcttggtggcagcagccacaagagccccactcccaggtgcagctggtgcagtctgggggctgaggtgaggaagcctgggggcctcagtgaaggtctcctgcaaggcttctggctacaccttcaccggcgactatctccactgggtgcgacacggccccctggacaagggcttgagtggatgggatggatcaaacctaacagtggtgcaacaaaactatgcaacagtaagttcgagggcagggtcacatcgacaggacacgtcatcagcacacgcctaacgagtggagctgacgcgagactgaacactcgtagaacgacgaccggtaccttaatttaacttacgttgttcgaccggtaaggtacgtttcgggtttaccgggtcggttcgtttaacggttttccgtttttaacggg

SEQ ID NO: 348536 - DNA, 603 bp, Homo sapiens
  misc_feature: GZ8MTXP01EFHQO.45.37.D04.1.454.CMB.2.raw
  modified_base (254)..(254): a, c, t, g, unknown or other
  misc_feature (254)..(254): n is a, c, g, or t
  modified_base (369)..(369): a, c, t, g, unknown or other
  misc_feature (369)..(369): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctgagtgaagtctctgcaggcttcgnggctacaccttcgaccggcgactatcctccacgtgggtacgccgacgacggcccccgtaggaaccgaaggggtctttggaagtgggagtgggataggactacccaaacccctaanaagtgggtacgaacaaacaacgtatcgacacagtaagtttcgaagggcgaggtcaacgatacgacgagggacacgtccagcagacacacgggacctaagagtaggacgcgagacgacgaacgtaccgtaggaactagttaacgacgaaaccgggtaccaacgggtacccttaattttaacgttccgttaggttgacggtaaggtagttcgggttacgggtgttcgttttccggg

SEQ ID NO: 348537 - DNA, 776 bp, Homo sapiens
  misc_feature: GZ8MTXP01DC7GA.45.37.D04.1.454.CMB.2.raw
  modified_base (246)..(246): a, c, t, g, unknown or other
  misc_feature (246)..(246): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcgagtcgtggggctggaggtgaggagccgtgggcctgagtgagtctctgcagctnggctacacctcaccggcactactctcccacgtgggtcgaccgacgacggcccccgtagggaaccgaagggggtcttaggaggttgggagttcgggggattacgggaactaacccgaaaaacccccccgttaaacgaaagttcggggtacggaacccaaaaacgtaaaaccgttgtacgaacctaaaccgtaaagggttaaacggtttaccgggaagggggacgtaacggggttacccaaaccgtaggtacggaaaccggtaacgggggaaccctacggttaccctaagaccgaacggaccaaaccggtaaccgtaccctaacgtaagggttacgggaaacgccgtaaggaaccggtactaaaacgggaccttacgggaaacctacgttccggtaaacggaacgaaacccggtaaccggttaaccttttaaagttttactttaaccgggttggttaacggtccgggtaaaggtttcggtttaccgggtttaccggggttgtttaaccgggttttcggttttttaacccggg

SEQ ID NO: 348538 - DNA, 546 bp, Homo sapiens
  misc_feature: GZ8MTXP01DNR3E.45.37.D04.1.454.CMB.2.raw
  modified_base (222)..(222): a, c, t, g, unknown or other
  misc_feature (222)..(222): n is a, c, g, or t
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
  modified_base (379)..(379): a, c, t, g, unknown or other
  misc_feature (379)..(379): n is a, c, g, or t
  modified_base (420)..(420): a, c, t, g, unknown or other
  misc_feature (420)..(420): n is a, c, g, or t
  modified_base (440)..(440): a, c, t, g, unknown or other
  misc_feature (440)..(440): n is a, c, g, or t
  modified_base (455)..(455): a, c, t, g, unknown or other
  misc_feature (455)..(455): n is a, c, g, or t
  modified_base (462)..(462): a, c, t, g, unknown or other
  misc_feature (462)..(462): n is a, c, g, or t
  modified_base (464)..(464): a, c, t, g, unknown or other
  misc_feature (464)..(464): n is a, c, g, or t
  modified_base (480)..(480): a, c, t, g, unknown or other
  misc_feature (480)..(480): n is a, c, g, or t
  modified_base (517)..(517): a, c, t, g, unknown or other
  misc_feature (517)..(517): n is a, c, g, or t
  modified_base (530)..(530): a, c, t, g, unknown or other
  misc_feature (530)..(530): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgagagctgggcctnagtgaggtctctgcaaggctcnggctacncctcaccggcgactatctccacgtgggtcgcgacacggcccccgtggaccaaggggtctttaggacggttggagttgggattggactaccgaaaccccctaacaaagtgggtggaccaaacgaaactntagaccaacagtaaacgtttcgagggtacagggtcaccgancgaccgagggacacgtacancagcactacgctacngtgagcngngcagctgacatcgaanacgacacggttctaatttattacgttgttgcgaagtnttcggttaccggnggtcgttggttttccg

SEQ ID NO: 348539 - DNA, 607 bp, Homo sapiens
  misc_feature: GZ8MTXP01DVBZG.45.37.D04.1.454.CMB.2.raw
  modified_base (254)..(254): a, c, t, g, unknown or other
  misc_feature (254)..(254): n is a, c, g, or t
  modified_base (371)..(371): a, c, t, g, unknown or other
  misc_feature (371)..(371): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcaggcttcnggctacacctcaccggcgactatctccacgtgggtgcgacacggcccctggacgaagggtcttggcgtggagtgggatggataccaaacccctacaagtggtggacaaacaaacttntcgcaacagtaagtttcgagggtctacgggtcaccgatagaccgaggaccacgtcatcgagacacgacgaccgttaacgagttagggaacgtcgtacggacgcgtaaacggcgttacggactaacgttcgtaacggaaccgacgacccggttacttaacgttttaacgttaccgttggttgccggtaggttcgtttacggttaccgggttggttccgttttaacggtttttcccgg

SEQ ID NO: 348540 - DNA, 684 bp, Homo sapiens
  misc_feature: GZ8MTXP01AUS66.45.37.D04.1.454.CMB.2.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgnggggctgaggtgaggaagccgtggggcctnagtgaaggtctctgcaaggcttcgtggctacaccttcaccggcgactatctccacgtgggtcgcgacgacggcccctgggacaaggggtcttgagtggagtgggatgggactaccccgaaaccctaaagaaacgttggggtacggaaccaaacctaaaccgttagtacggacctaaaccggtaaaggtaacggttttacggaacgggggtaccgtaacgggggttaccaaccgtaaggttacggaaccccggaaacggggggtaaccctaacccgggtaccctaaacgtacgaacgacccaaacgaccggggacccctaaacgtaggtacgggaacgttcgtacggacgacacggaactacggacacgttcacggaccgaaccgacgggtaccctaatttacgttacttcggttgacggtaagtacgttcggttacgtcggttcgttttccggg

SEQ ID NO: 348541 - DNA, 735 bp, Homo sapiens
  misc_feature: GZ8MTXP01AUQRM.45.37.D04.1.454.CMB.2.raw
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtgggcctcagtgaaggtctctgcgaaggtcttctggctacaccttcaccggcgactatctccacgtgggtcgcgacgacggcccccgtggaacaagggtcttggagtgggattggggatgggaactacccgaaaccctaaacgaagtgggtacggaaccaaactaaacctagtacggacaacgtaaggtaacggttttcggaaggggtcgtaagggggttaccaaccgaagttaccggaacccgaaacgggggaaccctaaccgggttaccccaaagttcccgaaacggaccaaacccgtacggggtaaccccttaaccggaagttaccggggaagcccgttaggaaggacccgtaagtacccgttaacggaacctacgttaaccgtaacggaacccgaaaccggttaccgggtacccttaaaggtttttacttaccgttggtaacgggtaccggtaaggggttacgttaccggggttttaacccggggttcggttccggttttttaaccggggg

SEQ ID NO: 348542 - DNA, 521 bp, Homo sapiens
  misc_feature: GZ8MTXP01AWGUU.45.37.D04.1.454.CMB.2.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
  modified_base (301)..(301): a, c, t, g, unknown or other
  misc_feature (301)..(301): n is a, c, g, or t
  modified_base (323)..(323): a, c, t, g, unknown or other
  misc_feature (323)..(323): n is a, c, g, or t
  modified_base (341)..(341): a, c, t, g, unknown or other
  misc_feature (341)..(341): n is a, c, g, or t
  modified_base (420)..(420): a, c, t, g, unknown or other
  misc_feature (420)..(420): n is a, c, g, or t
  modified_base (440)..(440): a, c, t, g, unknown or other
  misc_feature (440)..(440): n is a, c, g, or t
  modified_base (491)..(491): a, c, t, g, unknown or other
  misc_feature (491)..(491): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgngggctgaggtgaggagccgtggggcctnagtgagtcnctgcaggctngctacncctnacgnactatcncagtggncgacncgccctggacaggctgngtgngtggatggatacccaacctaanagtggagaacaacgaatngacacgagtaagtcgagggcaggtcacagtcgacgagggaccacgtcagtcacgacacacgtacgtacgagtagggacncgaggagaccgtagtacganaacctactcgacgacgaccacggtacttagtttacttcgttggtcgtaggnggttatagggtttccggtgttcgttttcgg

SEQ ID NO: 348543 - DNA, 639 bp, Homo sapiens
  misc_feature: GZ8MTXP01DYBRG.45.37.D04.1.454.CMB.2.raw
  modified_base (381)..(381): a, c, t, g, unknown or other
  misc_feature (381)..(381): n is a, c, g, or t
  modified_base (452)..(452): a, c, t, g, unknown or other
  misc_feature (452)..(452): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctgagtgaaggtctcctgcgaaggcttcgtggctacacctcgaccggcgactatctccacgtgggtgcgacacggcccctaggacgaagggcttaggagtggagtgggatggataccaaacccctaaacaaagttggacggaccaaaactaaactntacggacaacgaagtaacgtttacgacgggacgacgggtcaaccgagtacgaaccgagggaccacgtcacncgacgacaacacgaccctaagagtcgggagacctaggacgacgtaacgacgtacggaacacgttcgaacggaaaccgaaccggtaccggttacccttaaagttttaacgttaaccgttggttacggtaacggaggttaacgttacggggtttaccgttcgggttccgttttcgggtttttaacccgg

SEQ ID NO: 348544 - DNA, 614 bp, Homo sapiens
  misc_feature: GZ8MTXP01BKQF5.45.37.D04.1.454.CMB.2.raw
  modified_base (456)..(456): a, c, t, g, unknown or other
  misc_feature (456)..(456): n is a, c, g, or t
  modified_base (490)..(490): a, c, t, g, unknown or other
  misc_feature (490)..(490): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggacgccgtggggcctgagtgaggtctccgtgcgaaggcttcgtcggctacaccctcgaccggcgactatctccacgtgggtcgcgaccgacggccccgtagggaaccgaagggtcttaggagttggagtgggagtggactaccgaaacccccctaagagtcggtagaccaaacgaaactgtacgacacgtaagtaacgttcgagggacgaggtcaacgtagcgaacgacggacacgtacctanacagctaacgacgactacgagtgacgtccgaganacgaaggtactacgactacgtgtaaccggaacgaccgtaccggttacccttaaagttttacgttacgttgttcggaagtggtaacgttggtttaccggttgttaacgtttggtttttaacccgg

SEQ ID NO: 348545 - DNA, 603 bp, Homo sapiens
  misc_feature: GZ8MTXP01DXPX5.45.37.D04.1.454.CMB.2.raw
  modified_base (336)..(336): a, c, t, g, unknown or other
  misc_feature (336)..(336): n is a, c, g, or t
  modified_base (388)..(388): a, c, t, g, unknown or other
  misc_feature (388)..(388): n is a, c, g, or t
  modified_base (398)..(398): a, c, t, g, unknown or other
  misc_feature (398)..(398): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgaggacgggccaccatcaactgacaagtccagccagtagttgtttagacagctaccaaacaataaagaacttactagtcttacggtaaccaagacaaagaaaccaggtcacgccctacaagctagctactatttacgnggcactaccgtaccgggtacgtcccggggtcccctagaccgtatcaggtcgncggcggtcgngggacagtcttcactctacaccatccgagccgagccctagcgaggactagaaagtgttggggagtacgtttagttactgtactggtactagtacttaaattatttaattaataacctttcccgttacggtaccgtttccggaccggttacggaaacgttaaggttcggtaataacgtaaccaacggtaacgttgtcggctaaccg

SEQ ID NO: 348546 - DNA, 628 bp, Homo sapiens
  misc_feature: GZ8MTXP01AHQF7.45.37.D04.1.454.CMB.2.raw
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctcctgcaaggcttcgtggctacacccttcgaccggcgactatcctccgacgtgggtgcgacacggcccctggacgaagggcttggaggtggagtgggatggactccccgaaaccctaagagtggtaggaacaacgaactgtcgacacgtaagtaacgtttcgagggtcgaacggggtccaaccgagtacggaacccgaacgggtaccaccgtccacgtacacgacaccacggacccgtaacagtaccgggagccgtagacgacgagtaccgtgaacctacgttaacgacggaccggaaccgacggtacccgttaattttacttccgttaggtcggtacgtaagggtcgtttcggggtttaccggttcggttcggtttttaaccgggg

SEQ ID NO: 348547 - DNA, 748 bp, Homo sapiens
  misc_feature: GZ8MTXP01A3GQD.45.37.D04.1.454.CMB.2.raw
  modified_base (225)..(225): a, c, t, g, unknown or other
  misc_feature (225)..(225): n is a, c, g, or t
  modified_base (284)..(284): a, c, t, g, unknown or other
  misc_feature (284)..(284): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagcgtgggcctnagtgagtctcctgcaggctctggctataccctcaccggcgactatctaccacgtgggtnccgacaccggccccgtggaacgaagggtctggaggtggagtgggagtggataccaaaccccccgtaaagaagtgggtaaggaaacctaaaaattagtaacgacaaacgtaagtaaacggtttcgacggggtacgaaggggttaccaacgtagtcggaaacccggtaggggaacctacccggttcaacgtaccgacggaccaaaccgacggttacccaaaccgaggttacgggaacgtcgtacggaacgccgtaaaggtaaccgttacgaactaaccgttccgaacgggaaaccgtaacccggaaacccgggttacccttttaaagggtttttaaccttaaccggggttaggtttcccgggttacggggttaaagggttacggttttaaccgggggtttttaacccgggggtggggttttaccccgttttttccgggggtttttcccggttttttaacccggggg

SEQ ID NO: 348548 - DNA, 575 bp, Homo sapiens
  misc_feature: GZ8MTXP01EWISH.45.37.D04.1.454.CMB.2.raw
  modified_base (426)..(426): a, c, t, g, unknown or other
  misc_feature (426)..(426): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagccgtgggcctcagtgaaggtctctgcaggcttctggctacacctcaccggcgactatccccacgtggtcgcgacacggccccctggacaagggcttgagtggatgggatggatacaacctaacaagtggtaggcaacgaaaactatgcaacagaagtttccgaggggcagggtcacagtacgacgaggacacgtcatcagcacagcctagntcggagctgacgcgacgactgaacactcgacggaacgaccgacgggtcccttaaagttttacttaacgttggttcggaccggtaaggttcggttaacggttttaacccggggtggttccgtttcgggtttttcccgttttttaacgggg

SEQ ID NO: 348549 - DNA, 688 bp, Homo sapiens
  misc_feature: GZ8MTXP01AYV0L.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaagccgtggggcctcagtgaaggtctccgtgcgaaggtcttctggctacaccctcgaccggcactactcctccgaccgtgggtcgcgacacggcccctggaacgaagggtctggaggtaggagtgggtatggactacctaaaccccctaactagtcgggtacggaccaaaactaaactgtacggacaacgtaaggtaaagtttcgggacggggtaccgtaggggtacccaaccgacgtacgggaacccgagggggaaccctaccgttaccgacgtaacgacggaacctacgaaccggacccttaaacgacggttacggacgggttacccgaaggaccggacttaaacggacctaaggaacttaccgtacggtaacggaacccgttacgaccggttaccgttaatttaccgttagttggttagaaccgtaggtcgtttacggttcgggttgttccgtttcggtttttaacccgg

SEQ ID NO: 348550 - DNA, 580 bp, Homo sapiens
  misc_feature: GZ8MTXP01BBCAX.45.37.D04.1.454.CMB.2.raw
  modified_base (285)..(285): a, c, t, g, unknown or other
  misc_feature (285)..(285): n is a, c, g, or t
  modified_base (347)..(347): a, c, t, g, unknown or other
  misc_feature (347)..(347): n is a, c, g, or t
  modified_base (368)..(368): a, c, t, g, unknown or other
  misc_feature (368)..(368): n is a, c, g, or t
  modified_base (412)..(412): a, c, t, g, unknown or other
  misc_feature (412)..(412): n is a, c, g, or t
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcgtggggcctcagtgaaggtctcctgcaaggcttctggctacacctcaccggcgactatctccagtgggtncgacgacggcccctggaacaaggggcttggaggtggagtggatggataccaaaccccctaanaagtggtacgacaaacaaatngacacagtagttcgagggcaggtcacatgacagggacacgtcancagcaanacgcctaanacgtggaacgtcaggacgacgaaggacctagactacgtcgaagaaaccgaacgtacccggacttaaagtttaacctttacgttggttacggaaccggtaagggtaagtttcggggtttaccggttcggttccgtttcgggtttttaacccgg

SEQ ID NO: 348551 - DNA, 743 bp, Homo sapiens
  misc_feature: GZ8MTXP01C8SUS.45.37.D04.1.454.CMB.2.raw
  modified_base (231)..(231): a, c, t, g, unknown or other
  misc_feature (231)..(231): n is a, c, g, or t
tcagacgcgatcgacacgaccggtgctcgattttagtagcatactgttggggtttgggggcatcacccagcaaccacatctgtcctctagagaatccccctgagagctccgttcctcaccatggactggacctggaggatcctcttcttggtggcagcagccacaagagccccactccccaggtgcagctggtgcagtctgggggctgaggtgaggaagccgtggggcctnagtgaaggtctctgcaaggcttctggctacgaccttcaccggcgactatctccacgtgggtgcgacacggcccctggacaagggctggagtggagtggggatggactcaaaccctaacaagtggtaggacaacgtaaaaaactagtcgacaaacgtaaggtaaacgttttcgaagggggtcaaacgggggttaccaacgaacgtacggaacccgaacggggaaccaaccgggttaccaataccgaacggacctaaccgaacggtacccttaaccgaagttacgggggactaccgtaggaacgaccgtaacggaaaccgttcggaaacctaacgtttacccgacggggaaacccgaaacggttacccggggtaacccctttaaagttttaaacgtttaaccgttacgggttgggttaacccgggttaagggttaacggtttaaccgggtttttaaacccggggttcgggttaccggttttccggggttttttcccgttttttaaacccggggg

SEQ ID NO: 348552 - DNA, 711 bp, Homo sapiens
  misc_feature: GZ8MTXP01ACF7D.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttctggctacaccctcgaccggcgactatcctccacgtgggtgcgacgacggcccctggacgaagggtcttggaggtggagtgggatggactaccaaaccccctacaagtggtacggacaaaacgaaactgtcgaccaacgtaagtaaacggtttacgaacggggtacgaacggggttaccaaacccgtagttacggaaacccgaacgggggaaccctaaccgggttaccccaagttaccgaacgggacctaaacgtttaacccgggaccccgtttaaacgaaggttcggggaaacggtcccgttagggaacgaccgaagggtaacccttggaacctacgttacggtaacggaaccgttaccgtaccgggttaccttaaattttaacgttacgttggttacggaacgggtaggtaacgtttcggggtttacccgggttggttccgtttgggtttttaacccgg

SEQ ID NO: 348553 - DNA, 600 bp, Homo sapiens
  misc_feature: GZ8MTXP01CQHXE.45.37.D04.1.454.CMB.2.raw
  modified_base (226)..(226): a, c, t, g, unknown or other
  misc_feature (226)..(226): n is a, c, g, or t
  modified_base (254)..(254): a, c, t, g, unknown or other
  misc_feature (254)..(254): n is a, c, g, or t
  modified_base (345)..(345): a, c, t, g, unknown or other
  misc_feature (345)..(345): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctnagtgaggtctctgcaggctctggctacncctcaccggcgactatctccacgtgggtgcgacacggcccctggacgaagggcttaggagtggagtgggatggactccgaaaccccctaanaagtgggtagaccaaactaaactgtgaccaacgagtaacgtttcgaaggggacgacgggtacaaccgagtcgaaccgagggacacgtcagtcacgcacgacgaccgtacgagtcggaacgtcgtagacgacaacgaccgtagactacgttccgaaggaaaccgaccgtaacggttcccttaaagttttacttaacgttggttacggaacgaggttaagttcgggtttacggttggtccgtttggtttttaacccg

SEQ ID NO: 348554 - DNA, 519 bp, Homo sapiens
  misc_feature: GZ8MTXP01BEM36.45.37.D04.1.454.CMB.2.raw
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
  modified_base (489)..(489): a, c, t, g, unknown or other
  misc_feature (489)..(489): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacacctcaccggcgactatctccactgggtgcgacacggcccctggacaagggcttgagtggagtgggatggatcaaaccccctaacatggtggcaaacaaactntgacncaaaaaagtagtttcaggggcagggtcaccatgaccagggacacgtccatcacgcaacagcctacagtggagctgatcagactgacatctgacgacacggcctatttattcgttgttgcggaggnttcggttacggttggtcgttggttttcccg

SEQ ID NO: 348555 - DNA, 557 bp, Homo sapiens
  misc_feature: GZ8MTXP01DUYRO.45.37.D04.1.454.CMB.2.raw
  modified_base (225)..(225): a, c, t, g, unknown or other
  misc_feature (225)..(225): n is a, c, g, or t
  modified_base (367)..(367): a, c, t, g, unknown or other
  misc_feature (367)..(367): n is a, c, g, or t
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtgggcctnagtgaggtctctgcaagcttctggctacacctcaccggcgactatctccacgtgggtgccgacgacggccccctgggaaccgaagggcttggagtggagtgggatggatccaaacccctaagaagtggtagacaaacaaatntagcaacgagtaagtttcgagggcagggtcaacagtcgaacgagggacacgtcatcagcanacgcangtaggagcgtgagcaagctgacatcgaagacgacgaccggacttaaagtttcttacgttggttagtcggtaaggttcgtttacggtttaccgggttggttaacgtttcggttttttaacccgg

SEQ ID NO: 348556 - DNA, 607 bp, Homo sapiens
  misc_feature: GZ8MTXP01CE0EY.45.37.D04.1.454.CMB.2.raw
  modified_base (372)..(372): a, c, t, g, unknown or other
  misc_feature (372)..(372): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctctgcaggcttctggctacacctcaccggcgactatctccactgggtgcgacgacggcccctggacaagggcttggagtggagtggggatggatccgaaacccccctaacgaagtgggtacggacaaacaaacctntcgacacgagtaagtttcgagggcagggtcacgatagaccgagggaccacgtccagtcagacacacgacctacgagtgggacgcgtagacgcgaacgactgaactcgtccgtaacggaaccgacgtaccgggacccttaaagttttacgttaaccgttggttacggtaacgggtaacgtaaggtttcgggttttacccggggttaggttccgtttcgggtttttttaaccccggg

SEQ ID NO: 348557 - DNA, 582 bp, Homo sapiens
  misc_feature: GZ8MTXP01EDQCM.45.37.D04.1.454.CMB.2.raw
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
  modified_base (459)..(459): a, c, t, g, unknown or other
  misc_feature (459)..(459): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctgagtgaaggtctctgcagcttctggctacacctcgaccggcgactatctccacgtgggtgcgacgacggccccgtggaacgaagggtcttggagtggagtgggatggactaccaaaccccctaacagtggtcggacaaacaaactntgacanagtagttcgagggcagggtcacacgtacgaccgaggacgacgtacacgtacacgcacacgacctacgagtcggacgtcgngaggacacgactagacactcgtaacgaacggaccaccggttacgtaatttacgttaacgttcggttaggtcggtaggtaagttcggtttaccgggttgttccggtttcggttttttaaccggg

SEQ ID NO: 348558 - DNA, 523 bp, Homo sapiens
  misc_feature: GZ8MTXP01DE15G.45.37.D04.1.454.CMB.2.raw
  modified_base (364)..(364): a, c, t, g, unknown or other
  misc_feature (364)..(364): n is a, c, g, or t
  modified_base (485)..(485): a, c, t, g, unknown or other
  misc_feature (485)..(485): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctggggcctcagtgaaggtctcctgcaaaggcttctggctacacctcaccggcgactatcctccactgggtgcgacacggcccctggacaagggctgagtggatgggatggatcaaacccccctaacaatggtggacaacgaaactntgcaaccagaagtttcaggggacagggtcaccagtgacagggacacgtccagtcagcacacgctacagtaggagctgagcagactgacatctgacgacgacggcctatttacttacgttgngcgagtgtttggttaccggttggtccgttgttttcccg

SEQ ID NO: 348559 - DNA, 705 bp, Homo sapiens
  misc_feature: GZ8MTXP01CQV8L.45.37.D04.1.454.CMB.2.raw
  modified_base (252)..(252): a, c, t, g, unknown or other
  misc_feature (252)..(252): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctctgcaagcttcgnggctacacctcacggcgactactctccacgtgggtgcgacacggccccgtggaacgaagggcttggagtggagtgggatggataccgaaacccccctaagaagtggtacggactaaacgaaaacttgtagacgaaacgtaagggtaaacgtttcggaaggggacgtaacggggttaccaaccgtaagtacggaacccgaaggggaacctaaccggtaccgaactacgaaacggccaaacgaacggtacccgttaaacaaggttacgggacgtaccgtaggaacggcaaacgggtactaacggaactaacttccgtaacggaaccggaaaccgtccgggttaccttaaactttttacgttaaccgttgggttacggtaaccgggtaaaggttcgttttaccggggtttaacccgggttgggtttaacccggttttcggtttttttaaccccggg

SEQ ID NO: 348560 - DNA, 517 bp, Homo sapiens
  misc_feature: GZ8MTXP01AVYH2.45.37.D04.1.454.CMB.2.raw
  modified_base (351)..(351): a, c, t, g, unknown or other
  misc_feature (351)..(351): n is a, c, g, or t
  modified_base (445)..(445): a, c, t, g, unknown or other
  misc_feature (445)..(445): n is a, c, g, or t
  modified_base (470)..(470): a, c, t, g, unknown or other
  misc_feature (470)..(470): n is a, c, g, or t
  modified_base (501)..(501): a, c, t, g, unknown or other
  misc_feature (501)..(501): n is a, c, g, or t
tcagacgcgatcgacacgaccggtgctcgatttagtagcatactgttgggtttgggggagcatcacccagcaaacacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacacctcaccggcgactatctccactgggtgcgacaggcccctggacaagggcttgagtggatggatggatcaacccctacatggtgcaacaaactntgcacagaagtttcgagggcagggtcaccgatgaccgagggacacgtcatcagcactacgcctacagtggagctgagacaggactggacagtcngaacgacaccgggttcctaaatttnttacgttgttcgcgaggtaatgttaccgggngtcgttcggttttccg

SEQ ID NO: 348561 - DNA, 587 bp, Homo sapiens
  misc_feature: GZ8MTXP01AZMFO.45.37.D04.1.454.CMB.2.raw
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
  modified_base (451)..(451): a, c, t, g, unknown or other
  misc_feature (451)..(451): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtatctctgggcgagagggccaccatcaactgcaagtccagccagagtgttttagacagctaccaaacaataagaactaactagcttaggtaccagacaagaaaccaggtacagcctacctaagctgactactatttactggacagtaccgtacccgggaacgtcccggggtccccctaggaccgtattccgaggtcggcgaaggcgggtcgtaggggactagtactttacacttactacacctanacgaacncgacgcctgacgagntaaggagtagtggggtcgtacgttagtttacgtgtctgtacagtactaattattaattactaacttccgttacgtacgttccggacgtacggaacgttaagagtaataacgtaaccgaagtacgttcgtcgcgtcg

SEQ ID NO: 348562 - DNA, 526 bp, Homo sapiens
  misc_feature: GZ8MTXP01EAA20.45.37.D04.1.454.CMB.2.raw
  modified_base (253)..(253): a, c, t, g, unknown or other
  misc_feature (253)..(253): n is a, c, g, or t
  modified_base (342)..(342): a, c, t, g, unknown or other
  misc_feature (342)..(342): n is a, c, g, or t
  modified_base (362)..(362): a, c, t, g, unknown or other
  misc_feature (362)..(362): n is a, c, g, or t
  modified_base (413)..(413): a, c, t, g, unknown or other
  misc_feature (413)..(413): n is a, c, g, or t
  modified_base (434)..(434): a, c, t, g, unknown or other
  misc_feature (434)..(434): n is a, c, g, or t
  modified_base (450)..(451): a, c, t, g, unknown or other
  misc_feature (450)..(451): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcagtgaaggtctcctgcaaggcttcnggctacacctcaccggcgactatctccacgtgggtgcgacaggcccatggacaagggcttgagtggatgggatggatcccgaaacctanaagtggtggaacaacaactntgacacaagaagtttcgagggcagggtcaccatcgacaagggacacgtcancagcacaggctacagtggacncgtgagcagactgacnnctgacgacgacggtacctatttacgttcttgttcggacgtaaggtacttcggtttacgggtggttcgttttcggg

SEQ ID NO: 348563 - DNA, 644 bp, Homo sapiens
  misc_feature: GZ8MTXP01BG0RD.45.37.D04.1.454.CMB.2.raw
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctgagtgaggtctctgcaggctcnggctacnctcacggcgactatctccacgtgggtcgcgacgacggccccgtaggacgaagggcttaggagtggagtgggatggactaccaaaccccctaacgtaagtgggtagaccaaaacaaaactgtacgacaacgaaggtaacgtttcgagggggtacacggggtacaccgagtcgaaccgaggggaccaccggtcactcagcacacgcctacagtgggacgtcgtagacgaccgtaaggtacctcggaacctagttccgtaaggaaaccgaccgtaacccgggttacctttaaagttttaacgttaaccgttgggttacggtaaccgggtaggttaacgtttcgggtttaaccggggttcggtttaaccgttttcggggttttttaacccg

SEQ ID NO: 348564 - DNA, 668 bp, Homo sapiens
  misc_feature: GZ8MTXP01DCKRU.45.37.D04.1.454.CMB.2.raw
  modified_base (200)..(200): a, c, t, g, unknown or other
  misc_feature (200)..(200): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagacgcccactcccaggtgcagctggtgcagtcgnggggctggaggtgaggagccgtgggctgagtgaggtctcctgcaaggcttcgtggctacacctcaccggcgactatcctccgacgtgggtcgccgaaccgaccggcccccgtagggaaccgaagggggtcttaggaggtggagtgggatggaactaccgaaaacccccctaaagagttgggtacgaacaaaactaaaacttcgagacaacgtaaggtaaacgttcggaagggactagggtcaaccgagtacgaaccgagggacctacgtcaagcaacgctaacgacgtacctacgtaagtgggacgtacgtggaacgacgaaacggcttaacgactaccttcggtaacggaaccgaaccgtaccggttacctttaaagttttacgtttacgttgggttccgtaaggtaaaggttcgtttaccggggtttaacggttcgggtttccgttttcgggttttttaacccggg

SEQ ID NO: 348565 - DNA, 690 bp, Homo sapiens
  misc_feature: GZ8MTXP01EDGBZ.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactccccaggtgcagctggtgcagtcgtggggctggaggtgaggagccgtgggcctgagtgaaggtctctgcaggcttcgtggctacacctcgaccggcgactactctccctacgtgggtcgcgacgaccggccccgtagggaacgtaaggggtcttggaggtggagtgggtatggaactaccaaaacccccgtaacgaagttagggtacggaaccaaaacgtaaaactgtcgaaccgaacgaaaggtacgtttacggagggacgtacgggtacaaccgtaagtacggaaccgaggggtaaacctaccggtaccaagaccacggaccaacgaccggtacctaaacgtacggttagggaaccgttcgaaggaccgaagacggtaactacggaactactcggtaacgaccgaacggtaccgttaaccttaagttttacgttacgttggttaccggaaggtacggttaacggtttccgggtttaccggttggtttcccggttttcgggttttttaacccggg

SEQ ID NO: 348566 - DNA, 544 bp, Homo sapiens
  misc_feature: GZ8MTXP01ANEYX.45.37.D04.1.454.CMB.2.raw
  modified_base (342)..(342): a, c, t, g, unknown or other
  misc_feature (342)..(342): n is a, c, g, or t
  modified_base (362)..(362): a, c, t, g, unknown or other
  misc_feature (362)..(362): n is a, c, g, or t
  modified_base (465)..(465): a, c, t, g, unknown or other
  misc_feature (465)..(465): n is a, c, g, or t
  modified_base (468)..(468): a, c, t, g, unknown or other
  misc_feature (468)..(468): n is a, c, g, or t
  modified_base (490)..(490): a, c, t, g, unknown or other
  misc_feature (490)..(490): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacacctcaccggcgactatctccacgtgggtgcgacacggcccctggacaagggcttgagtggatgggatggatcaaaccccctanagtggtgacaaacgaaactntagacacaggtaagtttcgaggggacaggggtacaccgatcgaaccgaggggaccacgtccatcacgcaacagcctaacagtggacgctgagcaggactgacntcngaacgacgacggcctaagtttnttacgttgttacgcggtaggtgttcggttaccgggttggtcgttggttttcccg

SEQ ID NO: 348567 - DNA, 632 bp, Homo sapiens
  misc_feature: GZ8MTXP01DRIZ6.45.37.D04.1.454.CMB.2.raw
  modified_base (228)..(228): a, c, t, g, unknown or other
  misc_feature (228)..(228): n is a, c, g, or t
  modified_base (356)..(356): a, c, t, g, unknown or other
  misc_feature (356)..(356): n is a, c, g, or t
  modified_base (447)..(447): a, c, t, g, unknown or other
  misc_feature (447)..(447): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctnagtgaaggtctcctgcaaggcttctggctacacctcaccggcgactactctccacgtgggtcgcgacgacggcccctgggaacgaagggcttaggaggtggagtgggatggataccaaaccccctaanaagtggtaggaccaaaacaaactgtgacaacgaagtaacggtttacgaggggtcgagggtacaaccagtacgaaccgagggaccacgtcancagcacacgcctaacagtggacgcgtagacgacaagtaccttgaacctagtccgtaacggaaccgttaacggaaccggttccttaaagtttttaacttacggttggttacgggtaaccggttaagggttaacggttttcgggtttaccggggttcggtttccggttttcgggttttttaacccgg

SEQ ID NO: 348568 - DNA, 735 bp, Homo sapiens
  misc_feature: GZ8MTXP01DT1FP.45.37.D04.1.454.CMB.2.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagcgtgggcctnagtgaagtctctgcaggctcnggctacacctcgaccggcgactatctcccacgtgggtcgcgacgacggcccctaggaccgaagggtcttaggagtgggagtgggggatggaacttaccaaaaccccctaacgaagtgggtacggacaaaaccgaaaacttgtacggaaccaacgtaaaggttaaacggtttacggaagggggtacctaacgggggttaccaaccgtaaggtaccggaacccggaagggggaaaccctaaccggttaccaacgtaccgaacgacccgaaacgaccggtaccgttaaaccgaggtacgggaacgtacgacggaacgtacgaaacggtactacgggaaacctacgttaccgaaccgaacggttaacccgtaccggttaaccgtttaaacttttacgttaacggttcggttacgggtaaccggtagggttaacgtttccgggggttttaacccgggttacgggtttcccggtttaacgggttttttccccggg

SEQ ID NO: 348569 - DNA, 629 bp, Homo sapiens
  misc_feature: GZ8MTXP01CUZH7.45.37.D04.1.454.CMB.2.raw
  modified_base (294)..(294): a, c, t, g, unknown or other
  misc_feature (294)..(294): n is a, c, g, or t
  modified_base (371)..(371): a, c, t, g, unknown or other
  misc_feature (371)..(371): n is a, c, g, or t
  modified_base (441)..(441): a, c, t, g, unknown or other
  misc_feature (441)..(441): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaggcttctggctacacctcgaccggcgactatctccacgtgggtgccgacncggccccgtggacgaagggctggagtggagtgggatggataccgaaaccccctaacaagtggtggacaaacaaactntgacacgagtagttcgagggcagggtcacgagtcgaccgaggacacgtacatcagccacgacgaccgtanagtggacgcgtcgagacgacgacgtcgaactacgtcgtaacggaacggaacccgtaccgggttacctttaaacgttttaactttaccggttcgggttacgggtaaccgggtaagggttaacggttttaccggggttttacccggggttacgggtttccggttttaaccggggttttttttaacccggg

SEQ ID NO: 348570 - DNA, 539 bp, Homo sapiens
  misc_feature: GZ8MTXP01D71Z8.45.37.D04.1.454.CMB.2.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
  modified_base (363)..(363): a, c, t, g, unknown or other
  misc_feature (363)..(363): n is a, c, g, or t
  modified_base (416)..(416): a, c, t, g, unknown or other
  misc_feature (416)..(416): n is a, c, g, or t
  modified_base (441)..(441): a, c, t, g, unknown or other
  misc_feature (441)..(441): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctgggcctnagtgagtctctgcagctcngctacncctcaccgcgactatctccacgtgggtgcgacgacggcccctggacgaagggtcttggagtggagtgggatggactaccaaaccccctaacaagtggtcggacaaacgaaactntgacaacgagtaagtttcgagggacagggtcacagtgacgaggacacgtccancacgcaacacgacctacagtggacncgtagagcagactgactactcaagacacgacggttctaatttattacgttgttgaacgtagtcgttcggttaccggttcgttcgtttcggtttttccg

SEQ ID NO: 348571 - DNA, 844 bp, Homo sapiens
  misc_feature: GZ8MTXP01BQJI6.45.37.D04.1.454.CMB.2.raw
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagccccactcccaggtgcagctggtgcagtcgtggggctgaggtgaggagccgtggggcctgagtgaggtctcctgcaaggtcttctggctacaccttcgaccggcgactactctccgacgtcgggtcgcgaccgacgggcccccgtagggaaccgtaagggggtctttagggacggttagggaagttgggggaagttacgggtaactacccgtaaaaaccccgttaaaccgtaaacggttggggtacggaaccctaaaaccgtaaaaaaaacccgttagtaaccggaacctaaaccgtaaagggttaaacggttttaccggaacgggggtacgtaacgggggtacccaaaccgtaaggtaccggaaacccggaaacggggaacccgtaaccggttacccaacgtccgaaacggaccaaaccgaaccgtaccccttaacgggaaggttacggggaaccgtccggttaggaacggtacccgaaaggtaaccgttacgggtaaacctacgttacccggtaacgggtaaaccccgaaaccggttaacccgggttaacccttaaagtttttaacggttaccgttgggttacgggttaccgggtaagggttacggttttccggggttttacccggggttggggttcccgtttttaacggggtttttcccgttttaaccggggg

SEQ ID NO: 348572 - DNA, 722 bp, Homo sapiens
  misc_feature: GZ8MTXP01B2H30.45.37.D04.1.454.CMB.2.raw
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtgggcctnagtgagtctcctgcagcttcnggctacacctcgaccggcgactatcctccacgtgggtcgccgaccgacggtcccctgggaacgaaggggtcttaggaggttaggagttggggaattggaactaccaaaccccccgtaaacgaaagttcgggtacggaccaaaaacgtaaaacctgtacgaaccaaccgtaaaggttaacgtttacgggaacggggtacgacgggtaccaacccgtaaggtcggaacccgaaggggaacctaccgtaccactacgacgacacgacgacctaacgagtcgggaacgtcgtacggacgacgtaaacggtaccgttaggaaccctacgtttccggaacgggaacccggttaaacccgtaccgggttaccctttaaaggtttttaacgttaaccggttcgggttaggtaaccgggtaggtttaacgggtttacgggtttaccggggttacgggtttccgttttcgggtttttttcccggg

SEQ ID NO: 348573 - DNA, 582 bp, Homo sapiens
  misc_feature: GZ8MTXP01A2LWE.45.37.D04.1.454.CMB.2.raw
  modified_base (251)..(251): a, c, t, g, unknown or other
  misc_feature (251)..(251): n is a, c, g, or t
  modified_base (359)..(359): a, c, t, g, unknown or other
  misc_feature (359)..(359): n is a, c, g, or t
  modified_base (449)..(449): a, c, t, g, unknown or other
  misc_feature (449)..(449): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggagccgtggggcctgagtgaggtctctgcaggcttcnggctacaccttcaccggcgactatcctccacgtgggtcgcgacgacggccccctagggaacgaagggctttggaggtgggagtggggatggactacccaaaccctaanaagtgggtagaaccaacgaactgtacgacaacgaagtaacgtttcgacgggacgagggtcaaccgagtcgaaccgaagggacacgtccancagcacacggacctacgagcggagctggacgactacgacgtagacatcgacggacgaccgttaccggtaccttaattttacgttccgttgtggacgtaaggtacgttcggtttacccgggtgttcgttttcgg

SEQ ID NO: 348574 - DNA, 759 bp, Homo sapiens
  misc_feature: GZ8MTXP01EQGXP.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtggaggacgccgtggggcctcgagtagaggtcctcgtgacaaggtcttacgtggtacctaccaccttccgacccggcgtaccttacgtcctacccgtacggttggggtcgaccggacgtaccggaccccagttacgggaaccgtaagggggtccgtttagggaaggttgggaggttaggggtaagttacgggaaccttaacccccgaaacccccttaaagtaaggttcggggttacggaaacccaaacgtaaacccgttagttaaccggacctaaaccgtaaggttaacgggtttacggaacggggtacgtaacgggggttaccaaaccgtaacgtacggaaacccggaacgggggtaaccctaacggttaccccaagtaccgaacgtaccgaaccgtacggggaccttaacgaacgtacgggagtcgtacggaacgaccgtaaaggacctaggactacgtaacgacgaaccgacgttaccggtaccttagtttaacgttcgttcgtggacgtaagttcggttcggttacggtggtttaacgttttcggg

SEQ ID NO: 348575 - DNA, 637 bp, Homo sapiens
  misc_feature: GZ8MTXP01AWPEJ.45.37.D04.1.454.CMB.2.raw
tcagacgcgatcgacacgaccggtgctcgattttagtagcatactgttgggtttgggggcatcacccagcaaccacatctgtcctctagagaatccccctgagagctccgttcctcaccatggactggacctgtaggatcctcttcttggtggcagcagccacaagagccccactcccaggtgcagctggtgcagtcgtggggctggaggtgaggaagccgtggggcctcgagtgaaggtctcctgcaaggtcttctggctacaccttcgaccggcgactatcctccgacgtgggtgcgacgacggcccctggacaagggctgagtggagtgggatggaactaccaaacctaacgaagtggtaggacaacaaaactatcgacaagtagtaacgtttcgacgggacgacgggtacacgaagtacgaaccggaacgggaccaccggtaccagtaccgaacgaccaacgaccgaccctaacggagtagggacgtcgtaggaacgcgaagacgtacgactacgtcgacggaaccgacgaccggtaccttaagtttaacgtacgttggttcggttaccggtaagggtacgtttaaccgggtttaccggtcggttaccgtttccgggttttcgtttaaccggg

SEQ ID NO: 348576 - DNA, 594 bp, Homo sapiens
  misc_feature: GZ8MTXP01EPPC7.45.37.D04.1.454.CMB.2.raw
  modified_base (229)..(229): a, c, t, g, unknown or other
  misc_feature (229)..(229): n is a, c, g, or t
  modified_base (354)..(354): a, c, t, g, unknown or other
  misc_feature (354)..(354): n is a, c, g, or t
  modified_base (467)..(467): a, c, t, g, unknown or other
  misc_feature (467)..(467): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctnagtgaaggtctcctgcaggcttctggctacacctcaccggcgactatcctccacgtgggtcgcgacgacggccccgtaggacgaagggcttggagtggagtgggatggactaccaaaccccctanaaacgtgggtggaccaaacaaactgtgacacgagtaagtttcgagggcagggtcacgagtcgaccgagggacacggtacactcgacgcaacgacgacctaacagtggacgtcncgagcaacggctagactacgtcgaacgacgaccgacggttacccttaagttttaacttacgttggttacggtcggtaggtaagtttccgggtttacgggttcggttccgttttcggtttttcccggg

SEQ ID NO: 348577 - DNA, 680 bp, Homo sapiens
  misc_feature: GZ8MTXP01EXMRV.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctcctgcaaggcttctggctacacctcaccggcgactatcctccacgtgggtgcgaccgacggcccctggacaagggtcttggagtggagtggatggatccaaaccccctaacaagtggtgaccaaaacgaaactgtcgaccaacgtaaggtaacggtttcgagggtacgaggggtaccaaccgagtacggaaccgaaggggtaaccaccggttacccaacgtaccgaacgaccaaacgtaaccggaccctaacgtaaggtacgggaacgaccgtacggaaggaccgaaaggaccttaggaaccacgttccgtaacggaacccgaacgtaacccgggttacccgttaattttaacgttaaccgttgggttaccggtaagggtaaggttaacggtttcgggttttaacccgggttgggttccgttttcgggttttttaacccgg

SEQ ID NO: 348578 - DNA, 630 bp, Homo sapiens
  misc_feature: GZ8MTXP01BY9ZV.45.37.D04.1.454.CMB.2.raw
  modified_base (252)..(252): a, c, t, g, unknown or other
  misc_feature (252)..(252): n is a, c, g, or t
  modified_base (378)..(378): a, c, t, g, unknown or other
  misc_feature (378)..(378): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtgggcctcagtgaaggtctccgtgcaaggcttcnggctacacctccaccggcgactatctccacgtgggtgcgacgacggcccctggaccgaagggtcttggagtggagtgggagtggacttaccaaaccccctaagaagtgggtcgacaaaacaaactntcgacacagtaagtttcgagggacgaggtcaccagtacgaccgagggacacgtacactacgacgccaacgacgacccgtaacgagtcgggaacgtcgtacggacggtacaacggtacttacggaactacgttccgaacggaacccgaacgacccgggttcccttaaagttttacgttacgttggttcggaacggtacggtaacgttttcgggtttaccgggttgggttccgtttcgggttttttaaccccgg

SEQ ID NO: 348579 - DNA, 579 bp, Homo sapiens
  misc_feature: GZ8MTXP01AX3GA.45.37.D04.1.454.CMB.2.raw
  modified_base (252)..(252): a, c, t, g, unknown or other
  misc_feature (252)..(252): n is a, c, g, or t
  modified_base (444)..(444): a, c, t, g, unknown or other
  misc_feature (444)..(444): n is a, c, g, or t
  modified_base (464)..(464): a, c, t, g, unknown or other
  misc_feature (464)..(464): n is a, c, g, or t
  modified_base (496)..(496): a, c, t, g, unknown or other
  misc_feature (496)..(496): n is a, c, g, or t
tcagacgcgatcgacacgaccggtgctcgatttagtagcatactgttgggtttggggtagagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggaagccgtggggcctgagtgaaggtctctgcagcttcnggctacaccttcaccggcgactatcctccgacgtgggtcgcgaccgacggccccctaggaacgaaggggtcttaggaggtggagtgggatggactacccaaaccctaacgaagtggtcgaaacaacaacgtatcgacaacgagtaacgttcgacgggcagggtaccacgatacggacgaggtacacgtccancagcaacgacgggcctaagngtacggatcgagacgacgacggtactaggacncgtaacacggaaccgtacgacggtacttagtttaccttagttgtgacgtaaggtctttcgggttacggtgttcgttttccggg

SEQ ID NO: 348580 - DNA, 731 bp, Homo sapiens
  misc_feature: GZ8MTXP01DJIQF.45.37.D04.1.454.CMB.2.raw
  modified_base (228)..(228): a, c, t, g, unknown or other
  misc_feature (228)..(228): n is a, c, g, or t
  modified_base (290)..(290): a, c, t, g, unknown or other
  misc_feature (290)..(290): n is a, c, g, or t
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagccccactccccaggtgcagctggtgcagtcgtggggctgaggtgaggaagcctggggcctnagtgaaggtctcctgcaaggcttctggctacaccttcaccggcgactatctccactggggtncgacacggccccctggacaagggcttggagtggagtggggatggatcaaccctaacaagtggtggacaacgaaaaacttatcggacaacgtaaggtaaacgttttcgaacgggggctaagggggttaccaaacccgagttacgggaaaccccgaaagggggaacccaaccgggttacccaaagttacccgaaacgggccctaaaacccgaacggtacccccttaaacggacgttaggggaaacgtccgtaggaacggaccaaagggtaaccctggaaacctacgttccgttaacgggaaaccccggtaacgaaaccccggggttaacccttaagttttttaaacgttaaccgttgggtttacggaccggtaagggtacgtttaacgggtttttaccccggggtggttaccggtttccgggtttttaaccgttttaacgggg

SEQ ID NO: 348581 - DNA, 632 bp, Homo sapiens
  misc_feature: GZ8MTXP01DSH7W.45.37.D04.1.454.CMB.2.raw
  modified_base (226)..(226): a, c, t, g, unknown or other
  misc_feature (226)..(226): n is a, c, g, or t
  modified_base (253)..(253): a, c, t, g, unknown or other
  misc_feature (253)..(253): n is a, c, g, or t
  modified_base (448)..(448): a, c, t, g, unknown or other
  misc_feature (448)..(448): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagcgtgggcctnagtgaagtctctgcaggctctgctacnctcgaccggcgactatctccacgtgggtgcgacgacggtcccctggacgaagggtcttggaggtggagtggggatacgggataccaaaccccgtaacaagtgggtacgaccaaaactaaactgtgaccaagaagtaacgtttcggacggggacgtacggggtacaccgagtacgaaccgagggactacgtaccancagcacgacgcctacgagtcggagtctaggacacgaagaccgtagactacgttcgtaacggaacccgacggaaccggttaccctttaaagttttacgttaccgttgggttacgggtccggtaaaggttcgttttaccggggtttaccgggttcggtttaaccgttttcgggttttttaacccgg

SEQ ID NO: 348582 - DNA, 661 bp, Homo sapiens
  misc_feature: GZ8MTXP01AMLGT.45.37.D04.1.454.CMB.2.raw
  modified_base (181)..(181): a, c, t, g, unknown or other
  misc_feature (181)..(181): n is a, c, g, or t
  modified_base (224)..(224): a, c, t, g, unknown or other
  misc_feature (224)..(224): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagtagccacaagacgcccactcccaggtncagctggtgcagtcgtggggctggaggtgagagcgtgggcctnagtgagtctctgcaggtcttcgtggcctactacctcgaccggctactactcctccgacgtcgggtcgccgacgacggcccgtaggacgaaggtcgttggaggtggagtgggataggaactaccgaaacctaacgaagtggtacgaccaaacgaaactagtacgcaaagtacggtaaacgttcgaggggacgacgggtccaactagtacggaacgacgggacctacgtaccatacgacgacaacgacgtacctacgagggacggacgtctaacggacgacgaacggtactacggaactaccgttacggaccggaaaccgaaccgtaaaccggttccttaaacgtttaccgttaaacggtgttacggttcggttaggttaacggttacgggtttaaccggtggttccggttttacggtttcccggtttggtaacccggg

SEQ ID NO: 348583 - DNA, 571 bp, Homo sapiens
  misc_feature: GZ8MTXP01EXM65.45.37.D04.1.454.CMB.2.raw
  modified_base (229)..(229): a, c, t, g, unknown or other
  misc_feature (229)..(229): n is a, c, g, or t
  modified_base (482)..(482): a, c, t, g, unknown or other
  misc_feature (482)..(482): n is a, c, g, or t
  modified_base (498)..(498): a, c, t, g, unknown or other
  misc_feature (498)..(498): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggagatcctcttcttggtggcagcagccacaagagcccactcccaggtgcagctggtgcagtcgtggggctgaggtgaggaagccgtggggcctnagtgaaggtctcctgacaaggcttcgtggctacgaccttcgacccggcgactactctccacgtgggtcgacgacgacggcccctaggaacgaagggtcttgagtggagtgggatggactacccaaaccctaaagaatgggtacggaacaaacaactagtcgacaacgaaggtaagtttcgaagggcgagggtcaacgatacgaacgaagggacctacggtacagtacagacaacgtacggacttacagtggancgagagcacgacgtanactagcgtagacgacgacgtacttatttagttcgttgtgagtaaggtacgttggtttacggtgttcggtttcg

SEQ ID NO: 348584 - DNA, 602 bp, Homo sapiens
  misc_feature: GZ8MTXP01DOKHP.45.37.D04.1.454.CMB.2.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctnagtgaaggtctcctgacaggcttcnggctacacctcgaccggcgactatctccagtggtgcgacncggcccctggaacgaagggtcttggagtggagtgggatggactacccaaccctaagaagtggtacggaaccaacaactagtcgacaacgagtaagtttcgagggacaggtacacagtcgaacgagggacacgtcatacagacacacggaccctagagtcgggaagccgtagacgacgaaggtactaggaactgttaacgtaacggaccgaaccgttaccgggtaccttaagttttaacgttcggttacggttaaggacggtaagggttacgttcgggtttaaccgggttcgggttcgttttttccgggg

SEQ ID NO: 348585 - DNA, 742 bp, Homo sapiens
  misc_feature: GZ8MTXP01AIA9B.45.37.D04.1.454.CMB.2.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctnagtgaaggtctcctgcaggcttcnggctacncctcgaccggcgactactcctccacgtgggtcgccgaccgacggccccctagggaacgaaggggctttaggaggtggagtgggatggactaccgaaacccccctaacgaagtggggtacggaccaaaacgtaaaacttgtacggacaaacgtaaggtaacgggttttcggaaacgggggtaccgtaacgggggttacccaacccgtaacgttaacgggaaaccccggtaaacggggggaaacccctacccgggttaccctaaacgtacccgaaccgggaacccaacgttaaccggaccccttaaaccgtaaggtacggggaacgtcccgtaggaacggaccgaaacggttacccgtaggaaccctagttccgaacggaacccgacgtaacccgggttccttaaagttttacgttacgttggttacggtaacggtaggttcgtttacgggtttccgggttaggttccgtttcgggtttttccgg

SEQ ID NO: 348586 - DNA, 579 bp, Homo sapiens
  misc_feature: GZ8MTXP01E2JDU.45.37.D04.1.454.CMB.2.raw
  modified_base (374)..(374): a, c, t, g, unknown or other
  misc_feature (374)..(374): n is a, c, g, or t
  modified_base (478)..(478): a, c, t, g, unknown or other
  misc_feature (478)..(478): n is a, c, g, or t
  modified_base (495)..(495): a, c, t, g, unknown or other
  misc_feature (495)..(495): n is a, c, g, or t
  modified_base (528)..(528): a, c, t, g, unknown or other
  misc_feature (528)..(528): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaaggtctcctgcaaggcttcgtggctacaccttcgaccggcgactatcctccacgtgggtgccgaccacgggccccctagggacgaaaggggtctttaggaggtgggagttggggatgggactaccccaaaccctaaanaagtggtacggaacaaacaactatgacaacgagtaagttcgagggcagggtcacagtcgacgagggacacgtcatcgagacacacgggcctagagtggagtcgngagccaagtacagactntcgagaccgacgacggaccttatttacgttcgnggttcggacggtaagtagttcggttaccgggttcggttcgtttttccgggg

SEQ ID NO: 348587 - DNA, 620 bp, Homo sapiens
  misc_feature: GZ8MTXP01B7NYB.45.37.D04.1.454.CMB.2.raw
  modified_base (329)..(329): a, c, t, g, unknown or other
  misc_feature (329)..(329): n is a, c, g, or t
  modified_base (483)..(483): a, c, t, g, unknown or other
  misc_feature (483)..(483): n is a, c, g, or t
  modified_base (502)..(502): a, c, t, g, unknown or other
  misc_feature (502)..(502): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagtagttgtttagacagcctacaaacaataagaactactagcttacggtaccagacaacgaaaccgaggtacacgcctacctaagctgctactatttacgnggactactaccgtacccgggtaacgtccccggggtaccccctcggaacgtagttacgacggtcggaccgaagggtccgggtacgtcgggactagtactttccactcctacacgatcgagcagcccgtgccgaggtctaggaaagtcgttggggngggtactttaagtttcgtntccgtgtacaagtataaagtttattattacttctttccgccgtttacgttccggtacccggtagaaccgttaagttcggtaactacttaacgaaaacggtcttcggttcgcgttaacc

SEQ ID NO: 348588 - DNA, 644 bp, Homo sapiens
  misc_feature: GZ8MTXP01AWVHR.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtcgtggggctggaggtgaggaagccgtggggcctcgagtgaaggtctcctgcaaggcttctggctacacctcaccggcgactatctccacgtgggtgccgacgacggcccctggacgaagggcgttggaggtggagtgggagtaggaactaccgaaacccccctaacaagttgggtaggaccaaaacgaaactaagtcgacaacgaaggtaagtttacgagggacgacggggtacaaccgatacggaaccgaaggggaaccaccggttccaacgtccgagaccaacgacgaccgttaacgagttacggacgtcgagacgacgtaaggacctagaacctactcgtaacgaaccgacgtaccggttacctaagttttaacgttaccgttgttacggtcggaggttaagtttcgggtttaccggttggttaacgtttcgggtttttaacccg

SEQ ID NO: 348589 - DNA, 757 bp, Homo sapiens
  misc_feature: GZ8MTXP01CXY04.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccgaggtgcagctggtgcgagtcgtggggctggaggtgaggacgccgtgggcctgagtgaaggtcctcgtgacgaacggtcttcgtcggacctacctacctccgaccggtcgactactcctccgacggtggcgaccgaccgaccggtccccgtaggacgtaacggggtcttagggagttcgggagtggggagtacggactaaccaaaacccccgtaagtaaggtggtacggaaccctaaaaaacgtaaactaagtcgaaaccgtaacgtaaagggtaacgttcgggaagggtaccgaacgggtaccacgagtacgaaccgacgggaccaccggtcacgtacgacgaacctacgaccgtaacgtacgtaggtacgggacgtacgtacgggaactacgaaacggtaaccgtacggtaaacccacgttacccggtaaacggaaaccccggttaaccggtacccgggttacctttaaagttttacccgttagggttcggttaccgggtaaccgggttaaagggttccggttttaacggggtttcccgggttggtttaaccggtttttaaccgggtttttccccggg

SEQ ID NO: 348590 - DNA, 597 bp, Homo sapiens
  misc_feature: GZ8MTXP01C07BP.45.37.D04.1.454.CMB.2.raw
  modified_base (294)..(294): a, c, t, g, unknown or other
  misc_feature (294)..(294): n is a, c, g, or t
  modified_base (356)..(356): a, c, t, g, unknown or other
  misc_feature (356)..(356): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagacgcccactcccgaggtgcagctggtgcagtcgtgggggctgaggtgaggaacggcccggggcctcagtgaaggtctcctgacaaggcttctggctacaccttcaccggcactatctccacgtggtncgacaggcccctggacaaaggggtctgagtggatgggatggatcaaacccctaaacagtggngacaactaaaaactatgacaacgtaaagtaagttcgagggcgacggaccacatacgacgacggacgacgacactacacgacacacgacctacgtaacgtaggagacgtgagacgacgaacgtacgtactaactacgtacgaacgaacgaccggtaccgttaacgtttaactttacgttacgttggttacggtaaggtagttaacggtttacgggttcgggttcggttcggtttcgttttcg

SEQ ID NO: 348591 - DNA, 629 bp, Homo sapiens
  misc_feature: GZ8MTXP01AFPSY.45.37.D04.1.454.CMB.2.raw
  modified_base (372)..(372): a, c, t, g, unknown or other
  misc_feature (372)..(372): n is a, c, g, or t
  modified_base (467)..(467): a, c, t, g, unknown or other
  misc_feature (467)..(467): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagcctggggcctcagtgaaggtctcctgcaggcttctggctacacctcaccggcgactatctccacgtgggtgcgacacggccccgtggacgaagggcttagagtggagtgggatggtatcgaacccccctaacgacgtgggtaggacaaacaaacctntagacaacacgtaagttttcgacggggtcgacggggttcaaccgatacggaccacggggaccacggtccaactcacgacacgacgaccccttaanagtggaacgccgtaggaacgacgaacgacgtcggaacctaacgttccgtaacgaaccggaccgtaaccgggttacccgttaatttaacttacgttcgttacggtaaccggtagtaacggtttacggttacccgggttggttccgtttcgggtttttcccggg

SEQ ID NO: 348592 - DNA, 587 bp, Homo sapiens
  misc_feature: GZ8MTXP01CLDZY.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggagccgtggggcctcagtgaaggtctcctgcaaggcttctggctacacctcaccggcgactatctccacgtgggtgcgacacggcccctggacaagggcttggagtggagtgggatggataccaaacccccgttacaaagtggtggacaaacgaaaactgtcgacacgagtaagttcgagggcagggtcaaccgatacggaccgaagggacacgtccagtcagacacgagtacctacacgtggaacgctagagccgaagtaccgtaggacctaatccgtaaggaaccgacacggcccttaaagttttacttacgttgttcggaacggtaggttaagttcgggtttaccggttggtcttttaacgggtttttcccg

SEQ ID NO: 348593 - DNA, 745 bp, Homo sapiens
  misc_feature: GZ8MTXP01C97JU.45.37.D04.1.454.CMB.2.raw
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctctgcaaggcttcgtggctacaccttcaccggcgactatctccgacgtgggtcgcgacacggcccccgtaggaccgaagggggtctttaggaggtgggtagtggggagtagggactaacccccgaaaacccctaaacgaaagttcgggtcggaaaccaaactaaacgttatacggaacctaaacgtaaggtaaacggtttcgaaaggggtaccgtaacggggtaccaacccgaagtacggaaacccggaacggggacctaaccgtaccgaactacgaacggaccaacgaacggtaccccgttaaaccgaaggttacgggaacgtaccgtaggaaacggactaaacgggaacttacggaaacctagttaaccgtacggaaacccggaaaccgttaacccgggtaacccgtttaaattttaacgtttaccgttaggttaacggaaccggttaaggttaacggtttaccgggtttaccgggttcgggttcccggttttttaaccgggg

SEQ ID NO: 348594 - DNA, 620 bp, Homo sapiens
  misc_feature: GZ8MTXP01CPM5U.45.37.D04.1.454.CMB.2.raw
  modified_base (229)..(229): a, c, t, g, unknown or other
  misc_feature (229)..(229): n is a, c, g, or t
  modified_base (461)..(461): a, c, t, g, unknown or other
  misc_feature (461)..(461): n is a, c, g, or t
  modified_base (490)..(490): a, c, t, g, unknown or other
  misc_feature (490)..(490): n is a, c, g, or t
  modified_base (509)..(509): a, c, t, g, unknown or other
  misc_feature (509)..(509): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagacgcccactcccaggtgcagctggtgcagtcgtggggctggaggtgaggagccgtgggcctnagtgaaggtctccgtgcaagcttcgtggctacacctcgacggcgactatctccacgtgggtcgacgacgacggcccctagggacgaagggtcttggaggttggagtgggataggaactaccgaaaacccccctaaagaagtcgggtaggacaaaactaaaccgtgtacgacaacgtaagtaacgtttcgagggacgtacgggtacaccgagtacgaaccgaggacacgtcancagcacgacgacctagagtacggagacgngagacctaagactgaaccngtctaacggaacgacgtaccggttaccgttaattttaccgttacgttggttacgaacggtaggtaacgtttcgggttacccggttggttaacgtttcggtttttaacccgg

SEQ ID NO: 348595 - DNA, 599 bp, Homo sapiens
  misc_feature: GZ8MTXP01DFD34.45.37.D04.1.454.CMB.2.raw
  modified_base (491)..(491): a, c, t, g, unknown or other
  misc_feature (491)..(491): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccacatcaactgacaagtcagccagagttgtttagacagctaccaaacaataagaactactagcttgtaccagacaagaaaccaggtacagcctacctaagctgctactaatttacgtggactactaccgtaacccgggacgtcccggggtcccccctacggtaccgtatttcgaggtcggcaagggcgggtcgtaggggactagtactttcactctacacatcagacagcctgaccgtagctagaaagtgtggggtcgtacttaagtttagtggtctggtacaagtntaaattatttaattaggttaactttcccgttaccgttaccgtttcggaccccgttagggaaccttaaggttcggtaataataacgaaacgtagttggtcgttctaacg

SEQ ID NO: 348596 - DNA, 852 bp, Homo sapiens
  misc_feature: GZ8MTXP01CUIZ0.45.37.D04.1.454.CMB.2.raw
  modified_base (257)..(257): a, c, t, g, unknown or other
  misc_feature (257)..(257): n is a, c, g, or t
  modified_base (264)..(264): a, c, t, g, unknown or other
  misc_feature (264)..(264): n is a, c, g, or t
tcagacgcgatcgacacgaccggtgctcgatttagtagcatactgttaggtttgggggagcatcacccagcaaccacatctgtcctctagagaatcccctgagagctccgttcctcaccatggactggacctggaggatcctcttcttggtggcagcagccacaaagagcccactccccaggtgcggctggtgcagtcgtggggctgaggtgaggaagccgtggggcctcgagtgaaggtctcctgcaaggcttcgnggctacnccttcgaccgcgactatcctccacgtgggtcgaccgaccgacggcccccgtagggaaccgtaacgggggtctttagggaggttgggaagtgggggtagtacgggtaactacccgtaaaacccccgtaaaagtaaacggttaggggtacgggtaacccaaaaccgtaaaaaaaaaccgttaacgttaacggaacctaaaaccggtaaacgggttaaaaacggtttttaccccgggaaagggggtacccgtaaacgggggttaccccaaacccgtaacgttaaccggggaaaccccggaaaccggggtaaacccgtaaccgggtttaacccctaaagtaccccgaacgggacccttaaaccgaaccgggtacccctaaacgggtaacgttacgggggaaacgtccgttaacgggaaacgtccccggaaagtaaacccgggtacgaacctaaccgttacggtaacgaaacccggaacgttacccgggtaacccttagttttaaacgttaccgttaggttcggacggttaagggttaacgtttcggtttacggggttcgttacggttttccggtttttcgttttaaccgggg

SEQ ID NO: 348597 - DNA, 559 bp, Homo sapiens
  misc_feature: GZ8MTXP01BLGCK.45.37.D04.1.454.CMB.2.raw
  modified_base (279)..(279): a, c, t, g, unknown or other
  misc_feature (279)..(279): n is a, c, g, or t
  modified_base (286)..(286): a, c, t, g, unknown or other
  misc_feature (286)..(286): n is a, c, g, or t
  modified_base (406)..(406): a, c, t, g, unknown or other
  misc_feature (406)..(406): n is a, c, g, or t
  modified_base (423)..(423): a, c, t, g, unknown or other
  misc_feature (423)..(423): n is a, c, g, or t
tcagacgcgatcgacacgaccggtgctcgattttagtagcatactgttggggtttgggggcatcacccagcaaccacatctgtcctctagagaatccccctgagagctccgttcctcaccatggactggacctggaggatcctcttcttggtggcagcagccacaagagcccactcccaggtgcagctggtgcagtcgtggggctgaggtgaggaagcgtggggctcagtgaggtctcctgcaggctcgtggctacacctcgaccggcgactatctccnctgggtncgacgacggccccctggacaagggtcttggaggtggagtgggatggataccaaaccctaacgaagtggtaggacaacaaaactagtgacaagagtaagtttcgagggcgagggtcacganagacgaggacacgtcancagcacagcctagagtcggagctagacgacgtagactgactactccgagaacgtacgacggtaccttagtttactacgttgcgacgtaagggtattcggtttacccggtggttccgtttcggttttccgtttcggg

SEQ ID NO: 348598 - DNA, 723 bp, Homo sapiens
  misc_feature: GZ8MTXP01CSVNQ.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtggaggaagccgtggggcctcagtgaaggtctcctgcaggcttctggctacacctcaccggcgactatcctccacgtgggtcgccgacgaccggcccccgtagggaccgaaggggtcctttggaggttgggagtggggatggactaccgaaacccccctaagaagtgggtacggacaaaacctaaactgtacgaccaacgtaaggtaacgtttcggaagggggccgtaacggggttaccaacccgtagtaccgggaacccgaagggggaaccctaccgggttacccaacgtacccgaacgacccaaccgaaccggtacccttaacgaaggtcgggaaacgtccgtaggacgacgaacgtaccgttcggaacctagttcccgaacggaaacccgttaccgtaacccgggttacctttaaagttttacttaacggttggttacgggtaacgggtaggttaacggtttacgggttttaccggggttggttaaccggttttcgggttttttaacccgg

SEQ ID NO: 348599 - DNA, 613 bp, Homo sapiens
  misc_feature: GZ8MTXP01C4VNW.45.37.D04.1.454.CMB.2.raw
  modified_base (229)..(229): a, c, t, g, unknown or other
  misc_feature (229)..(229): n is a, c, g, or t
  modified_base (501)..(501): a, c, t, g, unknown or other
  misc_feature (501)..(501): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctnagtgaaggtctcctgcagcttctggctacacctcaccggcactatctccacgtgggtcgcgacgacggccccgtggaaccgaaggggtcttaggagttgggatggggatggactaccgaaacccctaacaagtgggtgacaaaacctaaactgtacgacaaacgtagtaaggttcgaggggtacgagggtcaaccagtcggaaccgagggaactacgtccaactaccaaacacgacgaccgtaacgagtagggacacgtagacgacagtacncgactagacgtaggaaccacgttaccggtacttagtttaacgttacgttggttcggttacgaaggttacgttcggtttacgggtcggttcgtttcggttttcgtttaacggg

SEQ ID NO: 348600 - DNA, 676 bp, Homo sapiens
  misc_feature: GZ8MTXP01C3ZRQ.45.37.D04.1.454.CMB.2.raw
  modified_base (370)..(370): a, c, t, g, unknown or other
  misc_feature (370)..(370): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcaaggcttcgtggctactacctcgaccggcgactactctcccacgtgggtcgccgacgaccggccccgtaggaacgtaagggtcgttggaggtgggagtgggataggactaccaaaccccgtaanaagtggtacgacaaaactaaactgtacgacaacgaagtaacggttacgagggcgagggtcaactagtacgaaccgagggacaccgtcagtacgacgcaacgaccgacgtaacgagtacgggagtcgacggacgacgtaacgtcgtacgtaccgtagtccggtaacgaaacccggttaaccgtacccggttaacctttaagttttaacgttaccggttggttacgggtaacggtaacgggttttaacggtttacgggttttaaccgggggttcggtttcccggttttcgggtttttttaaccccggg

SEQ ID NO: 348601 - DNA, 536 bp, Homo sapiens
  misc_feature: GZ8MTXP01AEXGB.45.37.D04.1.454.CMB.2.raw
  modified_base (335)..(335): a, c, t, g, unknown or other
  misc_feature (335)..(335): n is a, c, g, or t
  modified_base (338)..(338): a, c, t, g, unknown or other
  misc_feature (338)..(338): n is a, c, g, or t
  modified_base (354)..(354): a, c, t, g, unknown or other
  misc_feature (354)..(354): n is a, c, g, or t
  modified_base (383)..(383): a, c, t, g, unknown or other
  misc_feature (383)..(383): n is a, c, g, or t
  modified_base (422)..(422): a, c, t, g, unknown or other
  misc_feature (422)..(422): n is a, c, g, or t
  modified_base (442)..(442): a, c, t, g, unknown or other
  misc_feature (442)..(442): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttcgtggctacacctcaccggcactatctccatgtgtgcgacacggcccctggacgaggcttgagtggatgcgatgactcgaacctanagnggtagacaacaaactngacacagtattcgagggcagggtcacganacgacgagggtacacgtccatcagcaacgtagaccctanacgtggacgtcgacggaaancgtaaggacttacggaactaatccgaggaccgacgaccggtacccttagttttacttaccgtggtagcggagtattgtttaacgttgggttcgg

SEQ ID NO: 348602 - DNA, 652 bp, Homo sapiens
  misc_feature: GZ8MTXP01CY6WB.45.37.D04.1.454.CMB.2.raw
  modified_base (358)..(358): a, c, t, g, unknown or other
  misc_feature (358)..(358): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccgaggtgcagctggtgcagtcgtggggctggaggtgaggagccgtggggcctcagtgaaggtctcctgcaggcttcgtggctacacctcaccggcactatcctccacgtgggtcgcgacgacggccccgtaggacgaagggcttaggaggtggagtgggatggactaccgaaaccccctaanagtgggtacgaccaaaactaaactgtcgacaaacgtagtaaacgttcgaaggggcgaagggtccaacgagtacggaaccgaggggaacctaaccggtaccagtacgaacgacaaccgacgtacccgttaacgacggttcggaacgccgtaggacgacgaaggtacctaggaacctacgttcgaacggtaaccgacgtaaccggttacctttaaaggtttacttaacgttggacggtaacggtaaggtcgttttacggggtttaccgggttcggttcgttttcgggtttttccgg

SEQ ID NO: 348603 - DNA, 597 bp, Homo sapiens
  misc_feature: GZ8MTXP01C3UIZ.45.37.D04.1.454.CMB.2.raw
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (285)..(285): a, c, t, g, unknown or other
  misc_feature (285)..(285): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagtagccaacaagacgcccactcccaggtgcagctggtgcagtcgtggggctggaggtgaggaagcgtggggcctcgagtgaggtctctgcaggcttcngctacncctcacggcactactctccgagtgggtncgacgacggccccgtggaacgagggtcttggagtggagtgggatggaactaccaaacctaacgaagtgggtagacaaacaaactaatcgaacaacgtaagtaggttcgagggacgacgggtacacagtacgaaccgagggacctaacgtacacgtacacgacacgtacgacctaacgagggtaggacgctaggacgacgaagtacagactaagtcgtacgaccgaacgtacggacctttattagttacgtggttacgcgttaggttaacgttcggttaacggtcggtcgttcggtttccgtttggaaccggg

SEQ ID NO: 348604 - DNA, 585 bp, Homo sapiens
  misc_feature: GZ8MTXP01B94E3.45.37.D04.1.454.CMB.2.raw
  modified_base (231)..(231): a, c, t, g, unknown or other
  misc_feature (231)..(231): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (379)..(379): a, c, t, g, unknown or other
  misc_feature (379)..(379): n is a, c, g, or t
  modified_base (464)..(464): a, c, t, g, unknown or other
  misc_feature (464)..(464): n is a, c, g, or t
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagccccactccccaggtgcagctggtgcagtcgtggggctggaggtgaggaagccgtggggcctnagtgaaggtctctgcaaggtcttgtggctacaccttcgaccggcgactactcctccgacgtgggtcncgacncggcccctggacaagggtcttggagtggagtgggatggactaccgaaacctaacagtggtacgacaaacaaaactntgacaaacgagtaacgttcgagggcagggtaccacgagtacggacgaggacacgtcatcgagcaacacgaccctaggagtggacncgtagagccaagacctgaactatcgacggaacacgacgtacttagtttaacgtcgttggttcgacggtaagtacgtttcgggtttaccggtcggttacgtttcggttttccgtttaacggg

SEQ ID NO: 348605 - DNA, 521 bp, Homo sapiens
  misc_feature: GZ8MTXP01ATLCD.45.37.D04.1.454.CMB.2.raw
  modified_base (254)..(254): a, c, t, g, unknown or other
  misc_feature (254)..(254): n is a, c, g, or t
  modified_base (351)..(351): a, c, t, g, unknown or other
  misc_feature (351)..(351): n is a, c, g, or t
  modified_base (370)..(370): a, c, t, g, unknown or other
  misc_feature (370)..(370): n is a, c, g, or t
  modified_base (432)..(432): a, c, t, g, unknown or other
  misc_feature (432)..(432): n is a, c, g, or t
  modified_base (495)..(495): a, c, t, g, unknown or other
  misc_feature (495)..(495): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctctgcaaggcttcnggctacacccttcaccggcgactatcctccacgtgggtgcgacgacggccccctggacgaagggcttggagtggatgggatggatacccaacctaanagtgggtgaacaacaactntgcacagtaagttcgagggcagggtcacagtgacagggacacgtcatcagcacacggctacngtcggagtcagacgcagactcgacatcagacgacacggtctatttattacttgtgcgtaaggngttggttaccggtgttcgttttcggg

SEQ ID NO: 348606 - DNA, 668 bp, Homo sapiens
  misc_feature: GZ8MTXP01BX489.45.37.D04.1.454.CMB.2.raw
  modified_base (638)..(638): a, c, t, g, unknown or other
  misc_feature (638)..(638): n is a, c, g, or t
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagccccactcccaggtgcagctggtgcagtcgtggggctgaggtgaggagccgtggggcctcgagtgaggtctcctgcaaggcttctggctacaccttcgaccggcgactatctccacgtgggtgtgaccgacgggcccccgtggacgaagggtcttggaggtgggagtgggatggactaccgaaaccctaacgaagttgggtacggacaacgtaaaaactagtcgacaacgtaggtaaacgtttcggaaggggacgacggggttacccaaccgtagtacgggaacccgaagggggaacctaaccggttacccaagtacccgaacgaccgaaaccgacgtacccctaaacgggagttacggggacaccgtagacgccgaagacgtacgactacgttcgacggaaccgaccgttaccggtacctttaagtttacgtacgttggttgacggtaaggtacgtttcggtttacggnggttacgtttcggtttttccgtttaacggg

SEQ ID NO: 348607 - DNA, 612 bp, Homo sapiens
  misc_feature: GZ8MTXP01B24A7.45.37.D04.1.454.CMB.2.raw
  modified_base (249)..(249): a, c, t, g, unknown or other
  misc_feature (249)..(249): n is a, c, g, or t
  modified_base (370)..(370): a, c, t, g, unknown or other
  misc_feature (370)..(370): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtgggcctcgagtgaggtctcctgcaggcttcnggctacacctcgaccggcgactatcctccacgtgggtgccgacgacggcccctggacgaaggcgttgagtggatgggatggataccaaaccccctaacaagtcgggtagacaaacaaactntcgacacaagtaacgtttcgagggacgacgggtcaaccgagtcgaaccgaggggaaccaccgtccaagacacgacaacacgacctaacgagtcggaagtccgtagacgcgaacggactacggaactacgtccgaaggtaccgaaccgtaccggttcctttaagtttaacgttaacgttgttacggaacgtaggtaacgtttccgggtttacggttcggttcgtttccgggttttttaaccgg

SEQ ID NO: 348608 - DNA, 614 bp, Homo sapiens
  misc_feature: GZ8MTXP01EH3PQ.45.37.D04.1.454.CMB.2.raw
  modified_base (368)..(368): a, c, t, g, unknown or other
  misc_feature (368)..(368): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctgagtgaaggtctcctgcaaggcttcgtggctacacctcaccggcgactatctccacgtgggtgcgacgaggcccctggacaagggcttggagtggatgggatggatacaaaccccctaacaagtggtacggacaaacaaactntacgacacgaagtaagtttcgaaggggtctaggggtcaaccagtacgaaccgagggaaccgtaacgtccaataccagaccaacgtacgaccttaaccgaataggggaacgcgtacgacgacgtaacgacgtacgaactacgtctaacggaaccgacgtaccgttacgttaagtttaacgttacgttggttacggtaacggtaggttaacgtttacggtttacgggttcggttcgtttcggtttccg

SEQ ID NO: 348609 - DNA, 627 bp, Homo sapiens
  misc_feature: GZ8MTXP01D4LET.45.37.D04.1.454.CMB.2.raw
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagcgtgggctnagtgagtctctgcagctcngctacactcacggcgactactctccagtggcgcgacgacggcccctggacgaagggtcttaggagtggagtgggatggactaccaaacccccgtaatagtggtacggaaccaaaacgtaaactgtagaccaaacgtaaggtaacggttacggacggggtacgacgggtaccaacgtagtacgacgaacggtaccacgtccaatcgacgacaacacgactaacgagtaggactcgtagacgacgaacgtactacggaactacgtacgtaacgaacgaaccgtaccggttacctttaaagtttaacgttacgttcggttacgtaacgggttaggttaacggtttcggtttacgggttcgttaaccggttttcggttttaacccgg

SEQ ID NO: 348610 - DNA, 533 bp, Homo sapiens
  misc_feature: GZ8MTXP01ACUPC.45.37.D04.1.454.CMB.2.raw
  modified_base (224)..(224): a, c, t, g, unknown or other
  misc_feature (224)..(224): n is a, c, g, or t
  modified_base (358)..(358): a, c, t, g, unknown or other
  misc_feature (358)..(358): n is a, c, g, or t
  modified_base (445)..(445): a, c, t, g, unknown or other
  misc_feature (445)..(445): n is a, c, g, or t
  modified_base (462)..(462): a, c, t, g, unknown or other
  misc_feature (462)..(462): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagctggggcctnagtgaaggtctcctgcaaggcttctggctacacctcaccggctactatctccactgggtgcgacaggcccctggacaagggcttgagtggatggggatggatcaaacccctaacagtggtggacaaacaaactntagacaacagaaagtttcgagggtcaggggtcacgatgacccgaggggaccacgtcactcagacacgagtaccgtacagtgaacgcngagcgagactgacatcngacgacacggaccgtaattattacgttgttgaagaggtaagtggttacggttcggtcgttcggttttccgg

SEQ ID NO: 348611 - DNA, 720 bp, Homo sapiens
  misc_feature: GZ8MTXP01DX38X.45.37.D04.1.454.CMB.2.raw
  modified_base (248)..(248): a, c, t, g, unknown or other
  misc_feature (248)..(248): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggagcgtgggcctgagtgaggtctctgacagcttcgnggctactacctcgaccggcgtactactcctccgacggtgggtcgaccgacgaccggccccgtaggaacgtaacgggtcttaggagttagggagttgggaattacgggactaacccgtaaaaccccctaaagtaaggttcggggtacgaaccctaaaaaaccgtaaacgttaacgacgaacccgtaaaacgggtaaacggttaacgggtttaccgggaaaggggtaccgtaacggggtacccaaacgtaaggtaccggaaccggaaacggggtacctaaccgttaccagaccgaacgacctaacgaccggtacttaacgaggtacggaccgtagagacgtacgaacgtacgacgtacacgttacgaacggaacgacgtaccgttacttaatttacgttaggttgttcggtaaccggtaggtttcggtttacgggttacgggttccgtttaacggtttcggtttttaacccggg

SEQ ID NO: 348612 - DNA, 636 bp, Homo sapiens
  misc_feature: GZ8MTXP01D44KS.45.37.D04.1.454.CMB.2.raw
  modified_base (609)..(609): a, c, t, g, unknown or other
  misc_feature (609)..(609): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctggaggtgaggagccgtgggcctgagtgaggtctctgcgaaggcttcgtggctacaccctcaccggctactatctccacgtgggtgcgacgacggccccgtggaacgaaggggtctttaggaggttggagtggggatggactaccaaacccctaacaaagtgggtacgacaaaaccaaactgtagacaacgtaagtaacgtttcgaaggggtacacgggtaccaacgagacgaacgagggaaccacgtaccagtacacgacaacgacgaccttaacgagtgggaacgcgaggacgacgaacggtacctagaactacttcgaacgaaccggacgaaccggttaccttaagttttaacgttacgttggttccggtaagggtaaggtaagttttacggggtttaccggngggttccgtttcgggttttttaaccgg

SEQ ID NO: 348613 - DNA, 610 bp, Homo sapiens
  misc_feature: GZ8MTXP01D8T1D.45.37.D04.1.454.CMB.2.raw
  modified_base (237)..(237): a, c, t, g, unknown or other
  misc_feature (237)..(237): n is a, c, g, or t
  modified_base (318)..(318): a, c, t, g, unknown or other
  misc_feature (318)..(318): n is a, c, g, or t
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggtgagaggccacatcaactgcaagtccagccagagttgtttanacagactacaaacaataagaactactagcttggtaccagacaagaaaccgagtcagcctacaagctgctctaactttacgngggcagttaccgaccgggaacgtcccggggtcccctaggaccgtnttcgagtgacgnggcgggtcgtgggacagttctttcactctacacactcaacgcacggcctgaccgtagggactaggaaagtgtggggtagcttaaggtttgtgtctgtactaagtacttaaattatttaacgttacttccttccgttacccgtttaccgttccgggaccggtaacgggttaaccgttaaagggttacgtaacttaacgtaaccgtaaacggtacgttacggttaacggttctaacg

SEQ ID NO: 348614 - DNA, 796 bp, Homo sapiens
  misc_feature: GZ8MTXP01C1VH0.45.37.D04.1.454.CMB.2.raw
  modified_base (229)..(229): a, c, t, g, unknown or other
  misc_feature (229)..(229): n is a, c, g, or t
  modified_base (238)..(238): a, c, t, g, unknown or other
  misc_feature (238)..(238): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagacgcccactcccaggtgcagctggtgcagtcgtggggctggaggtgaggagccgtgggcctnagtgagtcnctgcagctcngctacnctcaccggcactactcctccacgtgggtcgaccgacgacggccccagtacggaacgaagggtctttagggagtgggtagtcggggtatacgggaacttacccccgaaaaccccgttaaagaagttcgggggtaccggtaaacccaaaaccctaaagttacgtacgggaaaccctaaaccgtaaaggggtttaaaccggtttacgggaacgggggttaccgtaaacgggggtaccaaacccgttaggtaacccggaaacccgggtaaacggggaacccttaaccgggtaccgaactaacccgaacgggacccttaaaccgaccgggggtaaccccctttaagggaaagttcgggggaacctacccgtaagggggaacctaacccgggtaaacgtaacccgtaacgtaaccgtaacgtaaccggtaaccggaaccggtaacccgttaacccgttaaccgttaacgttttacgtttacgttacggtaacggtacggtaacggttacggtttaccgggtttaccgggtttcgggtttcggtttcgg

SEQ ID NO: 348615 - DNA, 719 bp, Homo sapiens
  misc_feature: GZ8MTXP01DCL1N.45.37.D04.1.454.CMB.2.raw
  modified_base (254)..(254): a, c, t, g, unknown or other
  misc_feature (254)..(254): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagacgcccactcccaggtgcagctggtacagtcgtggggctggaggtgaggagcgtggggcctcgagtgaggtctcctgcgaaggtcttcgnggctacaccttcgaccggcgactatcctccacgtgggtcgcgaccgacggccccgtggaacgaaggggtcttaggaggtggagtgggatggactaccaacctaacaagtcgggtaggacaactaaacctagtacgaacaacgtaaggtaaacggttttacggaaggggtacgtacgggggtaacccaacccgtaagttaccggaaacccggaacggggaaccctaacccggtacccgaattaccgaacgaccaaccgacggtaaccctaaccgtaggggtacgggacgacgtacggagaccgaggacctacggaactacgttacgtaacggaaccgtaaccgtaccggttaccttaattttacgttaccgtaggttacggttccgggaaggtttaacggtttaccgggtttaacgggttcggttccggtttttcggttttaacccggtttcgggttaacccgggg

SEQ ID NO: 348616 - DNA, 641 bp, Homo sapiens
  misc_feature: GZ8MTXP01B62LZ.45.37.D04.1.454.CMB.2.raw
  modified_base (256)..(256): a, c, t, g, unknown or other
  misc_feature (256)..(256): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgacaacgtccagccagtagttgtttagacagctaccaanaaataagaactactagcttaggtaccagacaagaaaccaggtcacgcctactaagctgctactatttacgtgggactacgtcccgtaacccgggaacgtccccggggtccccctcggaccgtattcgaggtcggcgaacgggtcggggtcgtaggggactaggtactttcaccttcctaccaaccatcgaacgtcacgtcctgccgaaggccgtaagaaagtagttggggtaggttacgttagtttacgtgccgttaggactaagtaacttaaattatttaacttacttaaccttacccgttcgtaacccgtttccggacccttggggaaaccttaagggttacgtaataaccgtaacgtaaaacccgtgttggtcgaacgtccg

SEQ ID NO: 348617 - DNA, 659 bp, Homo sapiens
  misc_feature: GZ8MTXP01BIQWH.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctccgtgcaaggcttcgtggctacacctcgaccggcgactatcctccacgtgggtgacgacgacggccccgtggaacgaagggtcttaggaggtggtagtgggatgggaactaccgaaacccccgtaagaagtgggtacgaccaaacaaactgtgacctaaacgaagtaacgtttcgacgggtacgacgggtacaacgagtacgaaccgtaagggacctacggtaccacgtaccacggaccaacgtacggaccctaacgtacggtacgggaacgtcgtacggacgaccgtaacgtacgtacgaccgtaacgtccgtaacggaaccgacgtaaccggttacctttaaatttacgttacgttcggttagaacggtaggtcgtttacggttaccgggttggtccgttttcggtttttaaccgg

SEQ ID NO: 348618 - DNA, 654 bp, Homo sapiens
  misc_feature: GZ8MTXP01A0B35.45.37.D04.1.454.CMB.2.raw
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagccccactcccaggtgcagctggtgcagtctggggctgaggtgaggagccgtggggcctcagtgaggtctctgcaaggcttcgtggctacaccttcgaccggcgactatcctccacgtgggtcgcgacgacggccccctagggacgagggcttggaggtggagtggggatggactaccgaaacctaaccgaagtgggtaggaccaactaaaaaactatcgacaacgtaaggtaacgtttcgacggggctacgggtcaaccgagtacgaaccggaggggaacctaccggtacctactacgacgaccaacgacgtaccctacggagtagggacgtcgtaggacgacgaacggtaacgtcgaacctatacgtcgaaccgtaccgaccgggtacccttaatttaaacgttacttggttcggacggtaagggtagtttccgggtttaaccgggtcgggttccgtttcgggttttaacccgtttttaacgggg

SEQ ID NO: 348619 - DNA, 639 bp, Homo sapiens
  misc_feature: GZ8MTXP01CUDE6.45.37.D04.1.454.CMB.2.raw
  modified_base (259)..(259): a, c, t, g, unknown or other
  misc_feature (259)..(259): n is a, c, g, or t
  modified_base (297)..(297): a, c, t, g, unknown or other
  misc_feature (297)..(297): n is a, c, g, or t
  modified_base (354)..(354): a, c, t, g, unknown or other
  misc_feature (354)..(354): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtggggcctcagtgaaggtctcctgcaggcttcgtggctacnccctcgaccggcgactatcctccacgtgggtcgcgacncggcccctggacgaaggcttgaggttggagtgggatggactaccaaacccccctaanagtcggtggaccaaaacgtaaactgtcgaccaacgtagtaaggtttcgaggggtccgagggtaccaacccgagtacggaaccgaacggggaccaccggtaccagtaccgacgaccaaccgtacgtacccttaacgaggttgggaacgcttacggacgacgaggaccgtacgactactaccgaacgaaccggaccgtaccggaccttaagtttacttacgttggttcgggtaacggtaggttcgttacgggtttccgggttcggtttcgtttcgggtttttcccgg

SEQ ID NO: 348620 - DNA, 618 bp, Homo sapiens
  misc_feature: GZ8MTXP01BTGMG.45.37.D04.1.454.CMB.2.raw
  modified_base (336)..(336): a, c, t, g, unknown or other
  misc_feature (336)..(336): n is a, c, g, or t
  modified_base (395)..(395): a, c, t, g, unknown or other
  misc_feature (395)..(395): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaacgtccagccagtagttgttttagacacgactaccaaacaaataaagaactacgtagcttacggtaaccagacaacgaaaccgagtacacgcctactaagctgctactatttacgnggctacgtaccgtaccggacgtcccgggtacccctacggaccgtagtcgaggtcgacgnggtccgggtacgtgggactagtacttcgacctctacacctagtcagcgaacgcctggaccgagtacgtaaggaagtacgtgggggttacggtacctttagttagttcgacgttagtacgacgtactaatttatttagttacttccgttcccgttacgttccgttccgacccgtaggaaaccgttagttacggtaatacgaactaagattcgtaacggttctcg

SEQ ID NO: 348621 - DNA, 611 bp, Homo sapiens
  misc_feature: GZ8MTXP01C957H.45.37.D04.1.454.CMB.2.raw
  modified_base (293)..(293): a, c, t, g, unknown or other
  misc_feature (293)..(293): n is a, c, g, or t
  modified_base (370)..(370): a, c, t, g, unknown or other
  misc_feature (370)..(370): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctcctgcaaggcttctggctacacctcaccggcgactatctccagtgggtgcgacncggcccctggacaaggcttgagtggagtgggatggataccaaaccccctaacaaagtggtacggacaaaacaaactncgacacgaagtaagtttcgagggcagggtcacagtacgaccgaaggacacgtaccatacacgacacacgaccgtaacagtacggacgctaggacgacgaacgacgtggaacacttcgtaacggaaccgaacgtaccgggaccttaaattttaacgttaacgttcggttacggtaaccggtaagggtaacgtttacgggtttaccgggttcgggttaaccgtttcgggtttttttaacccgg

SEQ ID NO: 348622 - DNA, 635 bp, Homo sapiens
  misc_feature: GZ8MTXP01BGXU6.45.37.D04.1.454.CMB.2.raw
  modified_base (257)..(257): a, c, t, g, unknown or other
  misc_feature (257)..(257): n is a, c, g, or t
  modified_base (381)..(381): a, c, t, g, unknown or other
  misc_feature (381)..(381): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggagggtgaggaagccgtggggcctcgagtgaaggtctcctgcaaggcttcgnggctacacctcgaccggcgactatcctccacgtgggtcgcgacgacggccccgtggacgaagggcttggaggtggaggtgggatggaactccaaaccccctaagagtcggtgacaaacaaactntcgacacaagtaagtttcgagggacgtacgggtacaacgagacggaccgaagggacctacggtaccacgtacacgaccaacgaccggtacctaacgtacggtgggaaacgtccgtaggaaccggacaaacgggtacctaaggaacacgttaccgaacgaaccggaccaacgggttaccctaagttttaacgttacgttggcggtaaggtacgttgttacgggtttacgggttcgttcgtttcggtttttccggg

SEQ ID NO: 348623 - DNA, 686 bp, Homo sapiens
  misc_feature: GZ8MTXP01B1GF7.45.37.D04.1.454.CMB.2.raw
tcagacgcgatcgacacgaccggtgctcgatttagtagcatactgttgggtttggggagcatcacccagcaaccacatctgtcctctagagaatcccctgagagctccattcctcaccatggactggacctggaggatcctcttcttggtggcagcagccacaagacgcccactcccaggtgcagctggtgcaggtcgtggggctggaggtgaggagtccgtggggcctcgagtgaaggtctccgtgacgaggtcttcgtggctacaccttcgaccggcgactatctccgacgtgggtcgcgaccgacggccccgtaggaacgtagggtcgttaggaggtgggagtcgggatggactacccccgaaaccctaaagtaagtcggggtacgaaaccaaacgtaaaccgtagtaccgaccaaacgtaacgggttaacggtttacggaacggggtaccgtaacggggtacccaaacccgtagttaccgggaaacccggtaagggggaaccctaccggtaccctaaagtccaaacggacctaacccgaacggggtacccttaaacggaagttacgggaacgctacgggaacggactaacgacgtacgactcgtaacgtacgaccgaccgttacgtaccttatttacgttcgttgtcggacgtgtaggttcgttacggtcgttgttttccgg

SEQ ID NO: 348624 - DNA, 616 bp, Homo sapiens
  misc_feature: GZ8MTXP01EUAKF.45.37.D04.1.454.CMB.2.raw
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctctgcagcttcgnggctacncctcgaccggcgactatcctccacgtgggtcgcgacgacggccccctaggaacgaaggggtcttggagtggagtgggatggactaccgaaaccccctaataagtgggtacgaccaaacaaactgtagacaacgaagtaaacggttcgaagggtcgagggtacacgatacgaccgagggacacgtcagtcacgcacgacggacctacgagtcggagtccgtagacgacaagtactacggactacgttcgaacggtaacccgaaccgtaccggacctttaaagtttacttaaccggttgttaggtaacggaggtcgtttacggtttacgggttcgttaacgttttcggttttaaccgg

SEQ ID NO: 348625 - DNA, 635 bp, Homo sapiens
  misc_feature: GZ8MTXP01EJ6XZ.45.37.D04.1.454.CMB.2.raw
  modified_base (260)..(260): a, c, t, g, unknown or other
  misc_feature (260)..(260): n is a, c, g, or t
  modified_base (298)..(298): a, c, t, g, unknown or other
  misc_feature (298)..(298): n is a, c, g, or t
  modified_base (388)..(388): a, c, t, g, unknown or other
  misc_feature (388)..(388): n is a, c, g, or t
  modified_base (501)..(501): a, c, t, g, unknown or other
  misc_feature (501)..(501): n is a, c, g, or t
tcagacgcgatcgacacgaccggtgctcgattttagtagcatactgttggggtttgggggcatcacccagcaaaccacatctgtcctctagagaatccccctgagagctccgttcctcaccatggactggacctggaggatcctcttcttggtggcagcagccacaagagcccactcccaggtgcagctggtgcagtcgtggggctggaggtgaggaagccgtgggggcctcgagtgaaggtctcctgcaaggtcttcgnggctacaccttcgaccggcactatctccacgtggggtncgacgacgggcccctgggacgaagggtcttaggaggtggagtgggatcggaactaccaaaccctaaagaagtggtagacaacaaaaactntgacaaacgagtaagttcgacgggtcgacgggtcaacgatacggaccgagggacacgtcatcacgacatacgcctaacgagtagggactcgagcgacgagaaccgtgaaactnttaccgcggaaccgaccgttaaccggtcctttaaagtttacgttaacgttggttcggaaccgggttaagttacgggtttaacgggttttaccggggtcggtttcgttttcgggtttttaacccggtttaacggg

SEQ ID NO: 348626 - DNA, 876 bp, Homo sapiens
  misc_feature: GZ8MTXP01CMSDX.45.37.D04.1.454.CMB.2.raw
  modified_base (141)..(141): a, c, t, g, unknown or other
  misc_feature (141)..(141): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctnttcttggtggcagcagccacaagacgcccactcccaggtgcagctggtgcagtcgtgggctgaggtgaggaagccgtgggcctgagtgaacggtctccgtgacgtaaggtcttcgtcggaccttaccgtacccttacgacccgggtacgtacttactccgtacccgtaacggttcggggtacgaccggaaccgaccggggtaccccccgttaggggaaaccgtaaacgggggtccgtttagggtaacgggttcggggtaagtagggggtaagtttacgggaaactaaccccgtaaaaccccgttaaaagtaaacgggttacggggttacggaaaccgtaaaccgtaaaaaacccttagttaacgggaacccaaacggttaagggttaaaacgttttccggggaaacggggtaaccgggtaacgggtacccgtaaacccgtaagtaaccgggaacccgttaaccggggtaaacccacccggtttaaccctaaagcccgaaacggaacccgttaacaacggttacccccttaagggaacgttggggactaaccggtacgaacggaccgtaagtaaccgtacgtacctaacgtaccgaacgggtaaacccgtaccggttaacccggttacttaaacgtttacgtaacgggttcggttacggttacggttaacgggtttacggtttaacgggtttccgggtacggtttccggttttccgggttttaacggttaaccggg

SEQ ID NO: 348627 - DNA, 650 bp, Homo sapiens
  misc_feature: GZ8MTXP01AIKF5.45.37.D04.1.454.CMB.2.raw
  modified_base (371)..(371): a, c, t, g, unknown or other
  misc_feature (371)..(371): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctccgtgcaaggcttctggctacaccctcaccggcgactatctccacgtgggtgcgacgcggcccctggacaagggcttgagtggagtgggatggactacaaccccctaacaagtggtgacaaaacaaactntgacaacgagtaacgttcgagggcgagggtacaaccgagtacggaccgaaggggacctacgtaccatacgacgacaaccgacggaccttaacgagtacgggagtaccgtagacgaccgtaaggaactacggaaactaacgtccgtaacggaaccgaaccggaaacccgggttaccgttaaatttttaacgttaaccgtttcgggttaggtccgggtaaggtaacgtttcggggttttaaccgggttcggggtttaaccgtttcgggttttttaacccgg

SEQ ID NO: 348628 - DNA, 608 bp, Homo sapiens
  misc_feature: GZ8MTXP01BC4BV.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgccagctggtgcagtcgtggggctggaggtgaggaagccgtggggcctcgagtgaaggtctcctgacaaggcttcgtggctacacctcgaccggcgactatctccacgtggtgcgacgacggcccctggacgaagggtcttggacggtggagtgggatggactaccgaaaccccctaacgaagtggtacggacaaaccaaactgtagacaacgagtaacggtttacgaggggtcgagggtccacgagtcgaaccgaggaccacgtcatacagcacacgaccgtacagtgacgcgtgacgcgaacgactacggactactcggaacgaccgacgaccggttaccttaagtttaacttaccgttgttacggtaacggtacgtaaggtttaccgggttacgggttcggttcggtttcggtttttaacccggg

SEQ ID NO: 348629 - DNA, 596 bp, Homo sapiens
  misc_feature: GZ8MTXP01EMFH1.45.37.D04.1.454.CMB.2.raw
  modified_base (363)..(363): a, c, t, g, unknown or other
  misc_feature (363)..(363): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctccgtgcaaggcttcgtggctacaccttcgaccggcgactatctccacgtggtcgcgacgacggccccgtggacgaaggggtcttggaggtgggagtgggagtggactaccccaaaccctaanaagtgggtacggaaacaactaactatgacacgtaagtaagttcgagggcgagggtaccaacgagtcgaacgacgggacacgtacagtcagacacacgtactaacacgtggagcgtgagtacacgtactagacatcgtacgacgaaccgttacggtaccttaagtttacgttcgttaggtcggtacggtaagggttagttcggggtttaccgggtcgggttcgtttttccgggg

SEQ ID NO: 348630 - DNA, 812 bp, Homo sapiens
  misc_feature: GZ8MTXP01CCPOG.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccacatcaactgcaagtccagccagagtgtttagacagctaccaacaataagaactactagcttggtaccagacaagaaacccaggtacacgcctacctaagctgcttactatttacgtggctacgttccgtaacccggggaaacgtcccgggggtaccccctacggtaaccgtatttaccgaacggttcgggaccgtaacggggtccgggggttaccgtacggggggtaacctaacgggttaacttttacccgtaaacccgttcccgttaccaaacccgtacttacccgaacggtacccgaaaccggtccccgttagggaccccgtaagggtaccgttaaggaaaacggtacgtttcggggggtagggttaacccgtttaaaggttttttaacggtcgttacccgttgggttaacctaaaggtaacctttaaaagtttactttttaaagtttaacctttaacccgttttaccccgtttacccggtttaacccggttttacccgggtaacccccggtttaaggggttaaaccccgttaaaaggttccgggtaaactttaacgtaaccgtaaaaacccgggtgtttacgggtaacgttccgttaacccgg

SEQ ID NO: 348631 - DNA, 784 bp, Homo sapiens
  misc_feature: GZ8MTXP01A5TJ6.45.37.D04.1.454.CMB.2.raw
  modified_base (252)..(252): a, c, t, g, unknown or other
  misc_feature (252)..(252): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctgagtgaaggtctcctgcaggcttcnggctacacctcgaccggcgactactctccgacgtgggtcgcggaccgacggcccccgtagggaaccgtaagggtcgtttaggacggttagggagttgggggtaacttgggaaacttacccgaaaacccccgttaaacgtaaaggttcgggtacggaaccctaaaaaacctaaaaccgttaagtacgaaaccgaaacgtaaacgggttaacggtttaccgggaaaggggtaccgtaacggggtaccaaacccgtaggtacggaaaccggacggggtaaccctaacgttaccctaacgaccgaacgaccgtaacgaaccggtaccccgtaaacgtaagggttacgggacggttaccgtaggggaacctaacggaaacgtaacccgtaaggaacccgtacttacccgaaaggaacccgttacccggtaccggttacccgtttaagttttaacgttaccgttggttacgtaacgggtacggttaacgtttacgggttaccggggttcgttccggttttccgggtttttaacccggg

SEQ ID NO: 348632 - DNA, 613 bp, Homo sapiens
  misc_feature: GZ8MTXP01DHZKQ.45.37.D04.1.454.CMB.2.raw
  modified_base (388)..(388): a, c, t, g, unknown or other
  misc_feature (388)..(388): n is a, c, g, or t
  modified_base (505)..(505): a, c, t, g, unknown or other
  misc_feature (505)..(505): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaacgccgtggggcctcgagtggaacggtctccgtgcgaaggtcttctggctacaccctcgaccggcgactatctccgacgtgggtgcgaccgacggcccctaggacgaagggtcgttggagtggagtgggagtggactaccaaaccccctaacgagtggtacgacaaaacaaactncgacaacgagtaacgtttcgagggcgacgggtacaccgagtcgaccgagggacaccgtacacgtcaagacaacgacgacctaacagtacggacgcgtacgagcgtaagacgtagacnctcgtaacgacgaactccggaccttaatttacgttaccgttggttacgaacggttacggtcgtttacggtttacccggggttagtttccggtttcgttttttcccggg

SEQ ID NO: 348633 - DNA, 695 bp, Homo sapiens
  misc_feature: GZ8MTXP01AZK4V.45.37.D04.1.454.CMB.2.raw
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
  modified_base (482)..(482): a, c, t, g, unknown or other
  misc_feature (482)..(482): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtggaggaagccgtggggcctnagtgaggtctcctgcaggcttnggctacacctcgaccggcgactactccgtccgacgtgggtcgccgaccgaccggcccccgtagggaaccgtaagggtccgtttaggaggttgggacgtaggggacttacgggactaccaaaacccccccttaagagtgggtacgacaaaacgaaactgtcgaccaagtacgtaacgttcggaaggggccgtaagggtccaacgtagcggaaccgagggaccacgtaccanccgaacgacctacacgtaccctaagacggtacggaacgtcgacggaacgcccgaaaggtacctagggaaccctacgttaccggtaacggaaacccgttaccgggaacccgttaccgtttaaattttacgttaacgtttgggaacgggtaacggtaggttaacggtttcgggtttacccgggttggtttaacccgtttcgggttttttaaccgg

SEQ ID NO: 348634 - DNA, 633 bp, Homo sapiens
  misc_feature: GZ8MTXP01APUXZ.45.37.D04.1.454.CMB.2.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (508)..(508): a, c, t, g, unknown or other
  misc_feature (508)..(508): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtgggcctnagtgaaggtctctgacaggcttcgnggctacacctcgaccggcgactactctccacgtgggtcgacgacgcggccccgtggacgaaggggtcttggaggtggagtgggatggactaccgaaacccccgtacagtggtacgactaaaacgaaactgtcggaccaacgtaacggtaacgtttcggaacggggtacgtacggggtacaaccgagtacggaacccggagggaaccgacgttaccatcgaacgacaacgacgacctacgaggtacgacgtaccgngacgacaacggtactagtaacctcttacggaacggaaccgaccgtaaccggttccttaaatttacgttacgttggttacgaacggtagtaacgtttcggtaccggttgtcgtttcgttttaaccg

SEQ ID NO: 348635 - DNA, 662 bp, Homo sapiens
  misc_feature: GZ8MTXP01CKC1L.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcagtgaaggtctcctgcaggcttctggctacacctcaccggcgactatctccacgtgggtgcgacgacggcccccgtggacgaagggtcttggaggtggagtggggatgggactaccgaaacccccctaagaagttgggtacggaccaaaacgaaacctgtcgacacgagtaagtttcgaggggacagggtcacgagtacgaccgagggacctacgtaccgatacgagaccaacgtacggacctacgtagtgggaacgccgtaggacgacgtaacggacctaggaacctacgttacgtaacggaaccggttaaccgtaacccgggttacctttaaagtttttacgttaaccggttggttacgggtaaccggtagggtttaacgtttaccggggttttaccgggttcgggttaaccgttttcggggttttttaacccgg

SEQ ID NO: 348636 - DNA, 779 bp, Homo sapiens
  misc_feature: GZ8MTXP01BP8WU.45.37.D04.1.454.CMB.2.raw
  modified_base (249)..(249): a, c, t, g, unknown or other
  misc_feature (249)..(249): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggagccgtggggcctcagtgaaggtctctgcaggcttcnggctacacctcaccggcgactatcctccacgtgggtcgcgtaccgacggcccccgtgggacaaggggtctttaggaggttggagtggggatgggaactaccgaaacccccctaaacgaagttgggtacggacctaaaaccgtaaaacctaagtacggaccgtaaacgaaacgggttaaacggttttacggaacgggggtacggtacgggggttacccaaacccgtaacgtaccggaaccccggaacgggggtaacccctaacccgggttaccctaacgtacccgaacgggacccaaacgaccggacccgtaaacgtaacggtacggggaacgtccgtacggaacggtaccgaaacggtaacgttaccggaactacgttccgaacggaaccggttaaacccgaaccgggttacccttaaagttttaacgttacccgttggggttacgtaacccggggttaggttaacggggtttccgggttttaaccgggggttcgggtttcccggttttcggggtttttttaaccccggg

SEQ ID NO: 348637 - DNA, 674 bp, Homo sapiens
  misc_feature: GZ8MTXP01ANWKA.45.37.D04.1.454.CMB.2.raw
  modified_base (414)..(414): a, c, t, g, unknown or other
  misc_feature (414)..(414): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtggaacggtctccgtgacgaaggcttcgtcggacctacctaccctcgacccggcgtacctactcctaccacgtgggtcgccggtacgaccggtcccccgtaggaaccgaagggtcgttaggaggtggagtgggatgggactaccgaaaccccctaaagagtggacgacaaaaccgtaaactntacgacaagtagtaacgttcggagggacgtagggtacaaccgagtacggacccggaagggaaccctacgtaccaagtacaacgcctaacgacgacccgttagaacggttggaacgtccgaggacgacgacgtactacggactacggtctaacgacgacgtaacccggttcgttaattttaccgttagttcggttacgaacggggttgtaacggttccgggtttaccgggttcggttccgttttaacgggtttttccccgg

SEQ ID NO: 348638 - DNA, 654 bp, Homo sapiens
  misc_feature: GZ8MTXP01BI90P.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagcgtggggcctgagtgaaggtctctgcaggtctctggctacacctcaccggcgactactctccacgtggtgcgacacggccccgtaggacgaagggcttaggagtggagtgggatggactaccaaaccccctaacgtaagtgggtacgaccaaaacaaactaagtgaccaacgtagtaacgtttacgaggggactacggggtacaaccgagtacggaaccgacgggaaccacggtaccacgtacgaacgaccaacgacgacctacgtaacgtagggacgaccgtggaacgaccaaggtaaccgtaggaccctaagttccgtaacgaaaccgaacccgaaccggttacccgttaaattttaacgttaacgttggttacggtaacggtaggtaacgtttacgggttcccggttggttccgtttcgggttttttaacccgg

SEQ ID NO: 348639 - DNA, 625 bp, Homo sapiens
  misc_feature: GZ8MTXP01CIKPR.45.37.D04.1.454.CMB.2.raw
  modified_base (375)..(375): a, c, t, g, unknown or other
  misc_feature (375)..(375): n is a, c, g, or t
  modified_base (475)..(475): a, c, t, g, unknown or other
  misc_feature (475)..(475): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctcgagtgagtctctgacgagtctctggctacacctcgaccggcgtactatcctccacgtgggtcgccgacgacggccccgtggaacgaagggtctggaggtggagtggatggactaccaaaccccgtaacagtggtagacaaacaaactntgacgacgagtaacgttcgagggcgacgggtacacgtagtacgaccgacgggacaccggtactacacgacgacacgaccgacgtaacgacgtaggaccgngtacgacgtacgaaacgtctaacgacgtactcgtaacggaaccgttaaccggtaaccggttccttaaagttttaacgttacgtttcggacggtaaggtacggtaacgtttcgggttaccggttcggtaacgttttccgggtttttaaccg

SEQ ID NO: 348640 - DNA, 618 bp, Homo sapiens
  misc_feature: GZ8MTXP01C6D21.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactgtacctggaggatcctcttcttggtggcagcagccacaagagcccactcccaggtgcagctggcgcagtctggggctgaggtgaggaagccgtgggggcctcagtgaaggtctctgcaggcttctggctacacctcaccggcgactactctccacgtgggtgcgacacggcccctggacgaagggcttggaggtggagtgggatggactccaaacccccgtaagaagtgggtacgacaaaccaaactgtgacaacgagtaacgttcgaggggcgagggtcaaccgatacgacgagggacacgtccactcgacgcaacacgacctaacgagtaggacgctaggacgacgtaaggactagactacgttccgaacggaaccgacggtacccggcgttaaactttacgtttaaccgttggttcggtaaccgggtaggtaaggttttcggggtttaacccgggttcgggttaacgttttcgggttttttaacccggg

SEQ ID NO: 348641 - DNA, 663 bp, Homo sapiens
  misc_feature: GZ8MTXP01CMIII.45.37.D04.1.454.CMB.2.raw
  modified_base (359)..(359): a, c, t, g, unknown or other
  misc_feature (359)..(359): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctgagtgaaggtctcctgcaaggcttctggctacacctcgaccggcgtactactcctccacgtgggtgcgacgacggccccgtgggaacgaagggcttggaggtggagtgggatggactaccgaaaccccctaanaagtggtagacaaacaaactngacaanagtaagttcgagggcagggtcacgagtacgacgagggacacgtcatcacgacacgacgacctacgagtcggacgacgtagaacgtcgaaacggacttacgggaaacctacgttccggtaacggtaaacccggaaacccggtaaaccgggttaccccgttttaaattttaacgtttaaccggttgggttacgggtaaccgggtaacgggttaaggtttttaccggggtttaccggggttacgggtttccgggttttccggggttttttttaacccggg

SEQ ID NO: 348642 - DNA, 576 bp, Homo sapiens
  misc_feature: GZ8MTXP01A2PXP.45.37.D04.1.454.CMB.2.raw
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggagcctgggggcctcagtgaaggtctcctgcaaggcttctggctacaccttcaccggcgactatctccacgtgggtgcgacacggccccctggacaagggcttgagtggatgggatggatacaaaccctaaccaagtgggtggacaacaaaaacttatcgaccaacaaggtaacgtttcgaacggggtcgtaacggggtcaaccgaagtcggaaccgaaggggaccaacggtcccaatcagacacgagcctacgatgggagctgaagcaagacctgacatctgaacgacacggccttatttactacgttgttcggacgtaaggtacgttcggtttacgggtgggttacgttcggtttccgttttgg

SEQ ID NO: 348643 - DNA, 739 bp, Homo sapiens
  misc_feature: GZ8MTXP01CDMAZ.45.37.D04.1.454.CMB.2.raw
  modified_base (255)..(255): a, c, t, g, unknown or other
  misc_feature (255)..(255): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccaacaagacgcccactcccaggtgcagctggtgcagtcgtggggctggaggtgaggagccgtggggcctgagtgagtctcgtgcaggtcttgnggctacacctcgaccggctactatcctccgacgtggtcgacgacgcggccccgtaggaacgagggtctaggagtggagtgggatggaactacccccgaaacctagaagttcgggacgaacctaaacgaacttagacggaacctaacgaagggttaaacgggtttacgaacgggggtacgtaacggggtaccaaccccgtaaggtaccgggaaacccggaaacggggtaacccctaaccggttacccgaacaaccgaacgggacccaaacgacccggggtaaccccttaagggtaagaccggggtaaacgtcccggtacgggaaacgtaaccgtaacgtaaccgtacgtaaccgtaccgtaaccggtacggaacccggtaaccgttacgttaaccgtttaagtttacgttacggttacggtaacggtacgggttaacggtttacggtttaccgggtttaccgggtttcggtttccggttttccgg

SEQ ID NO: 348644 - DNA, 489 bp, Homo sapiens
  misc_feature: GZ8MTXP01BG3UJ.45.37.D04.1.454.CMB.2.raw
  modified_base (238)..(238): a, c, t, g, unknown or other
  misc_feature (238)..(238): n is a, c, g, or t
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
  modified_base (333)..(333): a, c, t, g, unknown or other
  misc_feature (333)..(333): n is a, c, g, or t
  modified_base (388)..(388): a, c, t, g, unknown or other
  misc_feature (388)..(388): n is a, c, g, or t
  modified_base (391)..(391): a, c, t, g, unknown or other
  misc_feature (391)..(391): n is a, c, g, or t
  modified_base (425)..(425): a, c, t, g, unknown or other
  misc_feature (425)..(425): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
  modified_base (476)..(476): a, c, t, g, unknown or other
  misc_feature (476)..(476): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagctgggctcagtgagtctctgcagntngctcactcacgcactatcncactggtncgacagccctgacaggctgagtgagtggatggatcaacccctaacaagtggtagacaaacaaactntagacacagtaagtttcgagggacagggtcacgatacgacgagggacacgtccancancacacgacctacagtgagctgagcagactgactnctaagaacgacgcgactattattacgttgttcgngtagngttcgttacggngtcgttgtttccg

SEQ ID NO: 348645 - DNA, 618 bp, Homo sapiens
  misc_feature: GZ8MTXP01AUYLY.45.37.D04.1.454.CMB.2.raw
  modified_base (256)..(256): a, c, t, g, unknown or other
  misc_feature (256)..(256): n is a, c, g, or t
  modified_base (495)..(495): a, c, t, g, unknown or other
  misc_feature (495)..(495): n is a, c, g, or t
  modified_base (520)..(520): a, c, t, g, unknown or other
  misc_feature (520)..(520): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctgagtgaaggtctcctgcaaggcttcgnggctacaccttcaccggcgactatcctccacgtgggtgcgacgacggccccctgggaaccgaagggcctttggacggttggagttgggatgggactaccccgaaaccctaagaagtggtaggaacaacaacgtagtaggaccaacgtaggtaaagtttcgaacggggaccgtaaggggtaccaacccgagtacggaaccgaaggggacctacgtaccagtacagacacgaggccctaangtaggagtccgagacgacgagtacngacagttcgagacgaccgacggtaccttaagtttacgttacgttggttaagacggtaaggtacgttacgggtttaccggtcggttcgtttttcccggg

SEQ ID NO: 348646 - DNA, 630 bp, Homo sapiens
  misc_feature: GZ8MTXP01CTJWO.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctcagtgaaggtctcctgcaggcttctggctacacctcaccggcgactatctccacgtgggtcgccgacacggcccctggacgaagggcttggagtggagtgggatggataccgaaaccccctaacgaagtgggtacggaccaaaacgaaactgtaggacctaacgaagtaacgtttcgaaggggtacgaggggttaccaccgagtacgaaccgaacggggaccacggttaccagtaccaacgccaacgacgacctaacgagtacggagtcgagacgcaagactagactacgtctaaggaacccgacgtaacggttcccttaaagtttacttaacgttgttacggtaacggtaggttaacgtttcgggtttaccgggttggttaaccgtttcgggtttttaaccg

SEQ ID NO: 348647 - DNA, 689 bp, Homo sapiens
  misc_feature: GZ8MTXP01A66SQ.45.37.D04.1.454.CMB.2.raw
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtggggcctcgagtgaaggtctctgcaggcttcnggctacncctcaccggcgactatcctccacgtgggtcgcgacgacggcccctggacaagggcttggagtggagtgggatggactaccgaaacccccctaacgaaagtgggtacggaccaaaacaaacttaagtacggaccaaaccgtagggtaaacgttttcggaaggggtaccgtagggggttaccaaccgaagtacgaacccggaaggggaacccaaccggttaccaactacgaacgaccaaccgacggtaccccttaacgaacgttgggaacgtcgtacgacgacgaacgactacggaactacgttccgaacggaaccggaaccgtaccgggacctttaaacgttttactttaaccgttggttacggaacggtagggttaacgtttcgggtttaccgggttcgggttccgttttaaccgggtttttttcccggg

SEQ ID NO: 348648 - DNA, 619 bp, Homo sapiens
  misc_feature: GZ8MTXP01EMSFD.45.37.D04.1.454.CMB.2.raw
  modified_base (251)..(251): a, c, t, g, unknown or other
  misc_feature (251)..(251): n is a, c, g, or t
  modified_base (355)..(355): a, c, t, g, unknown or other
  misc_feature (355)..(355): n is a, c, g, or t
  modified_base (376)..(376): a, c, t, g, unknown or other
  misc_feature (376)..(376): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcagtgaaggtctcctgcaaggcttcnggctacacctcgaccggcgactatcctccacgtgggtgcgacgacggcccctggacgaagggtcttggaggtggagtggggatggactaccgaaaccccctaanaagtggtagacaaacaaactntcgacaacagtaacgtttcgagggcagggtcaaccgagtacgaccgagggaccacgtacagtcagacacgacgcctaacagtagggacgctggacgacaagacctaggaacctgttaccgtaacggaaccgaaccgtaaccgggttacccttaaagttttacttaaccggttggttacggtaacggtaggtaacgtttcgggtttacccgggttgggttccgttttcgggttttttaacccgg

SEQ ID NO: 348649 - DNA, 654 bp, Homo sapiens
  misc_feature: GZ8MTXP01BSR6N.45.37.D04.1.454.CMB.2.raw
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggacgccgtgggcctcgagtgaaggtctcgngcgagcttcgnggctacncctcgaccggcgtactatcctccacgtgggtcgcgacgaccggccccgtaggaacgaagggtcgttaggaggtggagtgggagtggactaccaaacccctaacgagtcggcgacaaaacaaactgtcgaacaacgtaagtacgtttcgagggtcgacgggtacaaccgagtacggaaccgtaacgggaacctacccgtaccaacgtaccgaacgaccgaaaccaccggtaccctaagtacggtagggacgtacgaggacgacaacggtacttcggaactacgttcgaacgaacgaccgtaccggttaccttaagttttaacttacggttgttacggtaacggtagtttggtttcggtttacgggttcgttcggttttccggttttttaaccgg

SEQ ID NO: 348650 - DNA, 717 bp, Homo sapiens
  misc_feature: GZ8MTXP01EZSBO.45.37.D04.1.454.CMB.2.raw
  modified_base (263)..(263): a, c, t, g, unknown or other
  misc_feature (263)..(263): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtcgtggggctggaggtgaggaagccgtggggcctgagtgaaggtctcctgcgaggtctcgtggctacncctcgaccggacgactatcctccacgtgggtgccgacgaccggtcccccgtaggaccgtaaaggggcgtttaggaagggttggaggtaggggtacgtagggactaaccgtaaacccccccgtaaacgtaaggtcgggtacggaacccaaaaccaaacttaagtacggacctaaaccgtaaggtaacgggtttacggaacggggtacgtacggggtacccaaccgtacgtacgggacccgaaggggtaaccctaccggtaccacgacgacgacaaccgtaccgtacctaacgtaagtcgggacgacgtaggacacgaacgtacgtacgaactcgtacgaacgaaccgaccgtacggttacccttaagtttaacgttcgttggttacggaaccggtaagggtcgttttaccggggtttaccgggttacggtttccgttttaacggggtttttcccg

SEQ ID NO: 348651 - DNA, 820 bp, Homo sapiens
  misc_feature: GZ8MTXP01A71LO.45.37.D04.1.454.CMB.2.raw
  modified_base (329)..(329): a, c, t, g, unknown or other
  misc_feature (329)..(329): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagagttgtttagacagctaccaaacaataagaactactagcttaggtaccagacaaacgaaacccgaggtacagccctactaagctgactctatttacgnggactacgtccgtaaccccgggtaacgttccccgggggtacccctacggaaccgtagttaccgaggtcgggaccgtaacgggtccggggtaccgtacgggggacctaaggttacttttaccaaccttccttaccgaacccttagtcccgaaggacctaacccgggtcccgttacggacccggttaaggggaccgttaagggtaaaacggtggtttcgggggttacccgggggttaacttttaagggttttttaaccggttacggtcccgtttagggttaacctaaacgggttaaactttaaaacgtttttaaattttaaaccgttttaacgtttaaaccccttttacccccggtttaaccgggtttacccccggtttttacccggggaacccccggggtttaaggggttaaaaccccgttaaagggttacgggtaaacttaacgttaaacccgaaaaacgggttccgttagggtcggttaaccttaaccgg

SEQ ID NO: 348652 - DNA, 619 bp, Homo sapiens
  misc_feature: GZ8MTXP01ETQQD.45.37.D04.1.454.CMB.2.raw
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
  modified_base (386)..(386): a, c, t, g, unknown or other
  misc_feature (386)..(386): n is a, c, g, or t
  modified_base (451)..(451): a, c, t, g, unknown or other
  misc_feature (451)..(451): n is a, c, g, or t
  modified_base (486)..(486): a, c, t, g, unknown or other
  misc_feature (486)..(486): n is a, c, g, or t
  modified_base (525)..(525): a, c, t, g, unknown or other
  misc_feature (525)..(525): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctggaggtgaggagccgtggggcctnagtgaggtctcctgcaggcttcnggctacacctcgaccggcgactactcctccacgtgggtcgccgaccgacggcccccgtaggaccgaaggggtcttaggaggtggagtgggatggactaccaaaccccctaagaagtgggtacgacaaaacaaactntcgacacgaagtaacgtttacggacgggtacgacgggtacaaccagtacgaaccgagggtaaccncgtaccatcacgctacgacgcctacgagtaggacncgtagagacgaggacctagacctagtccgtaaggaaccncggaccgttaccttaagttttcttacgttggttacggaacgtaggtaacgtttcgggtttacgggttcggttaacgttttcggtttttaacccg

SEQ ID NO: 348653 - DNA, 732 bp, Homo sapiens
  misc_feature: GZ8MTXP01BP138.45.37.D04.1.454.CMB.2.raw
  modified_base (255)..(255): a, c, t, g, unknown or other
  misc_feature (255)..(255): n is a, c, g, or t
  modified_base (372)..(372): a, c, t, g, unknown or other
  misc_feature (372)..(372): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtggaggaagccgtggggcctcgagtgaggtctcctgacaggcttcnggctacacctcgaccggacgtactactcctccgtacgtgggtcgccgacgaccggcccctagggaacgaacgggtcttaggacgtggagtggggatggactaccaaacccccgtaanagtggtacgaccaaaacaaactgtacgaccaacgtaacgtaacggtttacggaggggtaccgtaggggtaccaaaccgtagaccggaaccgaggggaacctaccggtacacgtaccgaacgtcgaaacgaccgtacccgttaacgaggttacgggaccgacgtacgggacgacggaaccgttacgtacggtaaccctaagttcccgtaacggaaacccggaacccggtacccggttaacccgtttaaagtttaacgtttacccgttggggttaccggtaacgggtaaacgggttaacggtttttcggggtttaacccggggttacggttccgggtttttcccgggtttttttaacccggg

SEQ ID NO: 348654 - DNA, 735 bp, Homo sapiens
  misc_feature: GZ8MTXP01AD3SS.45.37.D04.1.454.CMB.2.raw
  modified_base (546)..(546): a, c, t, g, unknown or other
  misc_feature (546)..(546): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtgggcctcgagtgaaggtctcctgcaaggtcttcgtggcctactcccgtcaccgggctactatcctccacgtggggtcgcgaccgaccgggcccccgtaggaacgtaacggggtcctttaggaggttgggacgtaggggatagggaactaccctaaacccccgtaacagttgggacggaccaaaaactaaaaccgtgtcggaaccaacgtaacgggttaacgtttacggaggggacctacggggtacaaccgtagtacggaaccgagggaccacggtccaatccgaacgccaacgtacgaccccgtaagtaggtacgggacgtacgnggacgacgaacggttaacctggaaaactcgttccggtaacggaacccggttaaaccggacccggttaaccctttaaagttttaacccgttaaggttcgggttacccggtaagggttaacgggttaacggttttcccgggttttaacccggggttggtttcccggtttttcggggttttttaaccccggg

SEQ ID NO: 348655 - DNA, 594 bp, Homo sapiens
  misc_feature: GZ8MTXP01AWC8O.45.37.D04.1.454.CMB.2.raw
  modified_base (228)..(228): a, c, t, g, unknown or other
  misc_feature (228)..(228): n is a, c, g, or t
  modified_base (382)..(382): a, c, t, g, unknown or other
  misc_feature (382)..(382): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctnagtgaaggtctcctgcaaggcttctggctacacctcgaccggcgactatcctccacgtgggtcgcgacgacggccccgtggaccaagggcttgaggtggagtgggatggactaccaaaccccctaacgaagtgggtaggaccaaaaccaaactntagaccaactaggtaagtttcgagggcgacgggtcacgagtacgacgagggaaccacgtacagtacacgcacgacgtaccacagtcgagccgaggacagaagactggacctattccgaagaaccgcgtaaccggccttaagtttaacttaccgttgggttagccggtaggtaactttcggggtttaccgggttgtcgtttcgggtttttccg

SEQ ID NO: 348656 - DNA, 666 bp, Homo sapiens
  misc_feature: GZ8MTXP01EMHW0.45.37.D04.1.454.CMB.2.raw
  modified_base (307)..(307): a, c, t, g, unknown or other
  misc_feature (307)..(307): n is a, c, g, or t
  modified_base (373)..(373): a, c, t, g, unknown or other
  misc_feature (373)..(373): n is a, c, g, or t
tcagacgcgatcgacacgaccggtgctcgattttagtagcatactgttgggtttgggggcatcacccagcaaccacatctgtcctctagagaatccccctgagagctccgttcctcaccatggactggacctggaggatcctcttcttggtggcagcagccacaagagccccactcccaggtgcagctggtgcagtcgtggggctgaggtgaggaacgccgtggggcctcgagtgaacggttctccgtgacgaaggtcttcgtggcctacgacccttcgaccggcacttacgtctccgagtggggtnccgaacgacggccccctaggaccgaagggtcttggagtggagtgggatggactaccaaaccctaanaagtggtacgacaaacgtaaaaaacttgtcgacaaacgtaaggttaacggtttaccggaaggggcgtaacgggtaccaaaccgtaggtaccggaaccggaaacggggtaaccctaaccggtacctaacgtaccgaacgaccaacgacgtacccaggtagtcggaacgtcgaggacgacgacggactgactatcgagaacgacgacggtacttaagtttacgtacgttgttcggaggtaaggttacgtttcgggtttaccgggtgttacgtttccgtttttaaccgtttaaggg

SEQ ID NO: 348657 - DNA, 523 bp, Homo sapiens
  misc_feature: GZ8MTXP01AJB5B.45.37.D04.1.454.CMB.2.raw
  modified_base (485)..(485): a, c, t, g, unknown or other
  misc_feature (485)..(485): n is a, c, g, or t
  modified_base (498)..(498): a, c, t, g, unknown or other
  misc_feature (498)..(498): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccacgtggggtgcgacacggccccctggacaagggcttgagtggatgggatggatcaacctaacaatggtgcacaaaactatgacacagtagttcaggggcagggtcaccgatcgacgagggacacgtcatcagcacacgcctacgagtggagctgagcagactgacatctgaacgacacggccttatttactacttgttgcgtaaggtntcggtttaccggnggttccgttggtttccgttttaagg

SEQ ID NO: 348658 - DNA, 549 bp, Homo sapiens
  misc_feature: GZ8MTXP01CO5OI.45.37.D04.1.454.CMB.2.raw
  modified_base (227)..(227): a, c, t, g, unknown or other
  misc_feature (227)..(227): n is a, c, g, or t
  modified_base (342)..(342): a, c, t, g, unknown or other
  misc_feature (342)..(342): n is a, c, g, or t
  modified_base (360)..(360): a, c, t, g, unknown or other
  misc_feature (360)..(360): n is a, c, g, or t
  modified_base (419)..(419): a, c, t, g, unknown or other
  misc_feature (419)..(419): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctnagtgaaggtctcctgcaggctctggctacacctcaccggcgactatcctccacgtgggtgcgacacggcccctggacaagggcttggagtggagtggatggatcaaccccctaanatggtagcaaacaaactntgacaacagtaagttcgaaggggcagggtacaaccatgacccgagggaccacgtccaancaagcacacgcctaacgagtcggagctggacggcaacggactgaaccatcgcgacgttacgacggcctaaagttttattccgttgttagcgtagtgttcggttacggttcggtctttaacgggttttccc

SEQ ID NO: 348659 - DNA, 692 bp, Homo sapiens
  misc_feature: GZ8MTXP01BUV0U.45.37.D04.1.454.CMB.2.raw
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtggggcctcgagtgaaggtctcctgcaaggtcttcgtggctacaccttcgaccggcgactactcctccgacgttggggtcgcgacgacgggcccccgtagggaacgaaggggcttaggaggtgggagtgggggataggactaccgaaacccctaaacgtagttagggtacggaccaaactaaaaaaccttagtaacggaccaaacgaggtaaacgtttcggaggggtacgtaaggggtaccaaccgagtacgaaccgaacgggtaacaccgtacccatccgaagaccaacgacgacccctaagacgtaggacgtacgtagacgacgaagtacctagactacgtcgaggaaccgacgacccgggtaccttaagttttacgttaacgttcggttcggaccggtaagggttaacgtttcggggttttaacccgggttcggttccggtttttaacgggttttccccgttttttaacgggg

SEQ ID NO: 348660 - DNA, 604 bp, Homo sapiens
  misc_feature: GZ8MTXP01CHFZ9.45.37.D04.1.454.CMB.2.raw
  modified_base (345)..(345): a, c, t, g, unknown or other
  misc_feature (345)..(345): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcagtgaaggtctctgcagctctggctacacctcaccggcgactactctccacgtgggtgcgacgacggcccctggacgaggtcttgagtggagtgggatggataccaaaccccctaanagtggtgacaaacgaaactgtgacacagtaacgtttcgagggcacgggtacacagtacgacgacggacacgtcatcacgcacacgcgtaacagtcgagtcgagacgacgacggtactacggaacctagttaccgtaacggtaaccgacggacccggttaccgtttaaattttaacgttacgttcggttacgggtaacggacggttaacgttcgggttttaacccgggttggttaacccgtttaacgggttttttcccgg

SEQ ID NO: 348661 - DNA, 615 bp, Homo sapiens
  misc_feature: GZ8MTXP01CT901.45.37.D04.1.454.CMB.2.raw
  modified_base (498)..(498): a, c, t, g, unknown or other
  misc_feature (498)..(498): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaagccgtggggcctgagtgaacggtctctgcgagcttctggctacacctcgaccggcactatcctccacgtgggtgcgacgaccggccccgtaggacgaagggtctttggagttggagtgggataggactaccaaacccccgtaacgagtgggtacggaccaaaaacgtaaactgtacgacaacgaggtaacgttcggagggcacgggtcaaccgagtacgaccgagggactacgtaccactacgacgacacgaacgcctaagacggtaggacgctaggaacncgaacgactagactagtcgaacgaacacggtaccgttactttaagtttacttacgttggttacgtaacgggtagttcgtttcgggttcgggttacgttcggttttcggttttaaccg

SEQ ID NO: 348662 - DNA, 620 bp, Homo sapiens
  misc_feature: GZ8MTXP01EGAL2.45.37.D04.1.454.CMB.2.raw
  modified_base (295)..(295): a, c, t, g, unknown or other
  misc_feature (295)..(295): n is a, c, g, or t
  modified_base (352)..(352): a, c, t, g, unknown or other
  misc_feature (352)..(352): n is a, c, g, or t
  modified_base (371)..(371): a, c, t, g, unknown or other
  misc_feature (371)..(371): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctctgcaaggtcttcgtggctacaccttcgaccggcgactatctccacgtggggtgcgacncggccccctagggacgaagggtcttggagtggagtgggattggatacaaaccctaanagtggtgacaactaaaatntgacacgaagtagttcgagggcagggtcacgagtgaccgaggacacgtcatcagcacgagacctacggagtaggagtcgtaggacgacgtacgacgtcgaactaacgttccgacggaaccgaacgttaccggtaccctttaaagttttaacgttaacgttggttaccggttacgggtaagggttagtttccggggttttaaccggggtcggttccgttttaacgggttttttcccggttttaaccgggg

SEQ ID NO: 348663 - DNA, 681 bp, Homo sapiens
  misc_feature: GZ8MTXP01DMZM7.45.37.D04.1.454.CMB.2.raw
  modified_base (239)..(239): a, c, t, g, unknown or other
  misc_feature (239)..(239): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagccgtggggcctcagtgaaggtcnctgcaaggcttctggctacacctcgaccggcgactatcctccacgtgggtgccgaccgacggccccgtgggacaaggggctttggaggtggagtggggatgggataccaaacccccctaacgaaagtgggtaggaccaaaaccaaactgtgaccaaactaaggtaagtttcggagggggtaccagggggttaccaacccgtagtacgggaacccgaagggggtaccaacggttcccaataccgaagccaaacgacgtacccgtaaaccgaggttacgggaacgttccgaggacgaccgaaaggtacccttagggaactaccgttcggtaacggaaccgaaccggtaccggacccgtttaaattttaacgttaaccgttggttacggtccggtaaaggtcgttttacgggttacgggttcgtcgtttcggggtttttaacccg

SEQ ID NO: 348664 - DNA, 596 bp, Homo sapiens
  misc_feature: GZ8MTXP01CDNE9.45.37.D04.1.454.CMB.2.raw
  modified_base (330)..(330): a, c, t, g, unknown or other
  misc_feature (330)..(330): n is a, c, g, or t
  modified_base (372)..(372): a, c, t, g, unknown or other
  misc_feature (372)..(372): n is a, c, g, or t
  modified_base (384)..(384): a, c, t, g, unknown or other
  misc_feature (384)..(384): n is a, c, g, or t
  modified_base (471)..(471): a, c, t, g, unknown or other
  misc_feature (471)..(471): n is a, c, g, or t
  modified_base (579)..(579): a, c, t, g, unknown or other
  misc_feature (579)..(579): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgagacgggccaccatcaactgacaagtccagccagtagttgtttagacagctaccaaacaataagaactactagcttaggtaccagacaacgaaaccaggtcacgcctaccaagctgactactatttacgnggccacgtccgtaacccgggacgtcccgggtccccagacgtntcgaggtcgcgnggccgggtacgtgggactagtacttcactctacaccatcagccagcctgaccgagcaagacgtgttcggggtggtacttaggtttancggtctagtcaaagtactaaagtttacttattacgttaaccttccgttaccgtacccggttcgacccgtaagggttaaccttaggttcgaaattacgtaacaacggtnttacgtcggttctaacg

SEQ ID NO: 348665 - DNA, 696 bp, Homo sapiens
  misc_feature: GZ8MTXP01BQY63.45.37.D04.1.454.CMB.2.raw
  modified_base (251)..(251): a, c, t, g, unknown or other
  misc_feature (251)..(251): n is a, c, g, or t
  modified_base (258)..(258): a, c, t, g, unknown or other
  misc_feature (258)..(258): n is a, c, g, or t
  modified_base (286)..(286): a, c, t, g, unknown or other
  misc_feature (286)..(286): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtgggcctgagtgaaggtctctgcagcttcgnggctacncctcgacggcactatcctcacgtgggtnaccgacgacggccccgtaggacgaaggggtcttaggacgtgggacgtgggattgggactaccgaaaccccctacgtaagtggtacggaccaaaacgtaaactgtacgactaacgtaacgttaacggtttacggacggggtacctaacggggttaccaaccggtaggtaccgaaacccggaggggtaacccaaccgggttccaacgttaccgaacgaccgaaaccgtaccggtaaccctaacgtaaaggttcggggaactaccggttacgaacgacgaaacggtactaacggaaccttcgttaccgaacggaaccgttacgtacggttacccgttaaatttcgttaccgttggttacgtaacgtagggtaactttcggggttacgggttcgttcggttttaacgtttccgg

SEQ ID NO: 348666 - DNA, 635 bp, Homo sapiens
  misc_feature: GZ8MTXP01AHIZ7.45.37.D04.1.454.CMB.2.raw
  modified_base (252)..(252): a, c, t, g, unknown or other
  misc_feature (252)..(252): n is a, c, g, or t
  modified_base (352)..(352): a, c, t, g, unknown or other
  misc_feature (352)..(352): n is a, c, g, or t
  modified_base (372)..(372): a, c, t, g, unknown or other
  misc_feature (372)..(372): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtggggcctcagtgaaggtctcctgcaaggcttcnggctacacctcgaccggcgactatctccacgtgggtgcgacgacggccccgtggacgaagggcttgaggtggagtggggatggactaccaaacccctaanagtgggtgacaaacaaactngacaagagtagtttcgagggtcacgggtaccaaccgagtacggaccgtagggaacctaccgtaccgactaccgaacgaccaaccgacggtacccttaacgagttacgggaacgtcgtaggacgacgtaagacctacggaactacttcgtaacggaaccggaaccgtaccggttaccgttaaattttaacgttacgttcgggttacgcgggtaaggtaacgtttcgggttaccggggttgttccggttttcggtttttaaccgg

SEQ ID NO: 348667 - DNA, 688 bp, Homo sapiens
  misc_feature: GZ8MTXP01DRXH9.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagcgtgggcctgagtgaggtctctgacaggtcttcgtggctacacctcgaccggcgactatcctccacgtgggtcgccgacgaccggccccgtaggacgaaggggtcttaggaggtggaggtgggatacggactaccaaacccccctaaagtagtgggtacgaaccaaaactaaactgtacgaactaaacgtaaacggttaacggtttcggaacggggtacgaacgggtaccaaccgagtacggaaaccgagggaacctaccgtaccacgtacaacgacaaccgacgtacctaagagtacgggacgtcgaggacgacgaacggtactacggaactcgttacggtaacggaacccgttaaccgaccggttaaccttaaagttttaacgttcggttaggttacggtaaccgggtaggttaacggttttaccggggttacggttcgggtttccgttttcggggttttttaacccgg

SEQ ID NO: 348668 - DNA, 643 bp, Homo sapiens
  misc_feature: GZ8MTXP01DOSFT.45.37.D04.1.454.CMB.2.raw
  modified_base (355)..(355): a, c, t, g, unknown or other
  misc_feature (355)..(355): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctcgagtgaaggtctcctgcaaggcttcgtggctacacctcaccggcgactatcctccacgtgggtcgcgacgacggcccctggacaagggcttagaggtggagtgggatggactaccgaaaccccctaanaagtggtacgacaaaacgaaactgtgacaacgagtaagtttcgagggtacagggtacacgagtacgaccgaagggacctacgtaccacgtacgacgaccaacgtacgacccttacgacgttgggaacgtccaggacgaccgtaaagaccgtacggaactacgttccgaacggtaaccgaaccgtaccgggttaccctttaaagttttacgtttaaccgttcggttagtaaccggtaaggtcgttttacgggtttaccgggttggttccgtttttcgggtttttcccgg

SEQ ID NO: 348669 - DNA, 600 bp, Homo sapiens
  misc_feature: GZ8MTXP01C7UTQ.45.37.D04.1.454.CMB.2.raw
  modified_base (229)..(229): a, c, t, g, unknown or other
  misc_feature (229)..(229): n is a, c, g, or t
  modified_base (250)..(250): a, c, t, g, unknown or other
  misc_feature (250)..(250): n is a, c, g, or t
  modified_base (282)..(282): a, c, t, g, unknown or other
  misc_feature (282)..(282): n is a, c, g, or t
  modified_base (309)..(309): a, c, t, g, unknown or other
  misc_feature (309)..(309): n is a, c, g, or t
  modified_base (521)..(521): a, c, t, g, unknown or other
  misc_feature (521)..(521): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtgggcctnagtgaggtctctgcaggtctngctacacctcgaccggcactatctccagtggncgacacggcccctaggacgaggcttgnggtggatgggatggactacccaacctagagtgggtacgaacaactaactatcgaacaacgtaaggttaacgttcgggacggggtacgtacggggtaccaaccgtagtaccggaaccggaaggggtacctaccggtacacgtacgacggacctaaccgacggtacccttaacggagtaggacgtacgaggacgtacgagtacagactagtcgngaccgacgacgtcttaattaacgttcgttagtccggtaagtcggtacgttacgggtttacggtcggttcggttttccgg

SEQ ID NO: 348670 - DNA, 610 bp, Homo sapiens
  misc_feature: GZ8MTXP01BBAG2.45.37.D04.1.454.CMB.2.raw
  modified_base (379)..(379): a, c, t, g, unknown or other
  misc_feature (379)..(379): n is a, c, g, or t
  modified_base (435)..(435): a, c, t, g, unknown or other
  misc_feature (435)..(435): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctctgcagctctggctacacctcaccggcgactatcctccacgtgggtgccgacgacggcccctggaccgaagggcttggagtggagtgggatggactaccgaaacccccctaagaagtgggtacggacaaaacgtaaactntcgacaacgagtaagtttcgagggcacgggtcacagtgaccgagggacacgtcacncacgacacgacgacctaacgagtggacgtcgtagacgacgaacggtactaggaactacgttcgaacgaaccggacgtaccggttccgttaaattttaacgttaccgttggttacggaacgggtaggtaacgtttcggggtttacccgggttgggttccgtttgggtttttcccgg

SEQ ID NO: 348671 - DNA, 644 bp, Homo sapiens
  misc_feature: GZ8MTXP01BY56H.45.37.D04.1.454.CMB.2.raw
  modified_base (257)..(257): a, c, t, g, unknown or other
  misc_feature (257)..(257): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtggaggaagccgtggggcctcgagtgaaggtctctgcgtaggcttcgnggctacctacctcaccggcgtactatcctccagtgggtcgcgacgcggccccgtaggaccaaggtcgtggagtggagtggatggactaccaaacccctagaagtggacgacaaaactaaactgagaccaagtaaggtaacgtttcggacgggacgtaggggtaccaacgtacgtacgaaccggaagggtaacccacgttcccaacgtacgacgaccacgaaccggtaccctagtaacgtgggaacgtcgtaggacgacgacgacctagaactacgtcgtaacggaaccgacgtaccggttaccttagtttaacgttaccgttggttacggtaacggtaggttcgtttaacgggtttccggttggttccgtttcggtttttaacccgg

SEQ ID NO: 348672 - DNA, 602 bp, Homo sapiens
  misc_feature: GZ8MTXP01CCYOK.45.37.D04.1.454.CMB.2.raw
  modified_base (395)..(395): a, c, t, g, unknown or other
  misc_feature (395)..(395): n is a, c, g, or t
  modified_base (452)..(452): a, c, t, g, unknown or other
  misc_feature (452)..(452): n is a, c, g, or t
  modified_base (535)..(535): a, c, t, g, unknown or other
  misc_feature (535)..(535): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccacttccaggtgcagctggtgcagtcgtggggctggaggtgaggaagccgtggggcctcgagtgaaggtctcgtgacgaaggtcttcgcggctaccacctccgaccggcgtactatcctccacgtgggtcgccgacgacggccccgtaggaccgaagggtcttggaggtggagtgggatggactaccgaaaccccctaagtaagtgggtacgacaaacgaaactntcgacaacgagtaagttcggagggacagggtcacgtagacgacgacggacacgtcancacgacacacgactacgtagtgaacgcgtagacgacgaagacgtagactactcgaacgaacggaccgtaccgacttaacgttnttacgttggttacggcggtaggtcggtttcgggttaccgggttcgggttcgtttcggttttaaccgg

SEQ ID NO: 348673 - DNA, 638 bp, Homo sapiens
  misc_feature: GZ8MTXP01D2404.45.37.D04.1.454.CMB.2.raw
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (290)..(290): a, c, t, g, unknown or other
  misc_feature (290)..(290): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggagccgtggggcctcagtgaaggtctcctgcaaggcttcgnggctacncctcgaccggcgactatctccacgtgggtnccgacgacgcccgtggacgaagggtcttggagtggagtgggatggactaccaaacccctaacaagtggtcgacaaaacaaactgtgaccaagaagtaacgtttcgaggggaccagggtcacgagtacgacgagggacacgtccatacgacgcaacacggtacctaacgtaggtacggacgccgtagaacggcaaaggtccttaggaacctcgttccgaacggaaccgttaaccgaaccgggttaccctttaaagttttaaccttacggttggttacggtaaccggtaaaggttcgtttacgggtttacccggttggggttaaccgttttcggggttttttaacccggg

SEQ ID NO: 348674 - DNA, 727 bp, Homo sapiens
  misc_feature: GZ8MTXP01AUUL9.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtgggctgagtgaggtctctgcagcttcgtggctactacctcgaccggcgtactatcctccacgtgggtcgcgtacgacggccccgtaggacgaagggtcttggaggtgggagtagggtagtcggaactaccgtaaacccccgtaaactaggtcgggtacggacctaaaacgaaaccttgtacggacctaaacgtaacggtaacggttttacggaacgggggtaccgtaacgggggttacccaaacccgtaaggttaaccggggaacccgaacggggggtaaacccctaccgggtaccctaacgtaccggaacgtaccctaaaccgaccggtacccttaacgaggttacgggacgtacgtacggacgaccgtaacggacttacggaactacgtaccgaaggtaccgaacggtaaccggttcctaagtttacttaccggttgttcgggtaagtacgggtaacgtttccggggtttacggttacgggttcgttttcgggtttttaacccggg

SEQ ID NO: 348675 - DNA, 709 bp, Homo sapiens
  misc_feature: GZ8MTXP01DYT0B.45.37.D04.1.454.CMB.2.raw
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagccccactcccaggtgcagctggtgcagtcgtggggctgaggtgaggagccgtggggcctgagtgaggtctctgcaggtctgtgctacactcacggcgactatctcacgtgggtcgcgacgacggcccctagggacaagggtcttggaggtgggagtggggagtcggactaccgaaaccctaacgtagttagggtcggaacctaactaaaaaacttgtaacggaccaaaccgtaaagggttaaacggtttacgaagggggtaccgtaacggggttaccaaccgtaagtacggaaccggaacggggaaccgaaccggttacccaataccgaacggacccaacgaacgtacccttaacggaaggtacggggtaacgacgtaggaccgacgaaggtaaacccttggaacctacgttaccgacggaaacccggaccgacgggtaccctttaattttaacgttcgttaggttcggttaccgggtaagggtacgtttcgggtttaccgggtcgggtttaccgtttcgggttttccgtttttaacgggg

SEQ ID NO: 348676 - DNA, 634 bp, Homo sapiens
  misc_feature: GZ8MTXP01ER7EK.45.37.D04.1.454.CMB.2.raw
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccaacaagacgcccactcccaggtgcagctggtgcagtcgtggggctggaggtgaggagccgtgggcctgagtgagtctcngcagntcngctacacctcgaccggcactactctccacgtggtcgcgacgacggccccgtgggaacgaagggtcttaggaggtggtagtgggagtggaactaccaaaccccctaagaggtggtacgacaaaacaaacgtaagtcgacaacgagtaagtttcggacgggacgtacgggtaccaacgacgtacgaccgaggaccacgtaccatacgacgcaacacgtaccagtagtacggacgacgtacgacgacgacggtactacggaactacgtcggtaaccggaacggaaccggtacccggttaccttaagttttacgtttacgttcgttaggtaacgggtagtaacgtttcgggtttacccgggttgggtttcgttttcgggtttttaaccggg

SEQ ID NO: 348677 - DNA, 619 bp, Homo sapiens
  misc_feature: GZ8MTXP01A1Q84.45.37.D04.1.454.CMB.2.raw
  modified_base (373)..(373): a, c, t, g, unknown or other
  misc_feature (373)..(373): n is a, c, g, or t
  modified_base (457)..(457): a, c, t, g, unknown or other
  misc_feature (457)..(457): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctggaggtgaggaagccgtggggcctcagtgaaggtctcctgcaaggcttctggctacacctcaccggcgactagtctccacgtgggtgcgacacggcccctggacaagggctgacgtggatgggatggatccgaaacccccctaacgaagtggtggaccaaacgaaactntcgcaacgagtaagtttcgagggtcagtgtacacatacgacgagggacacgtcatcagcacacggtacctactagacgggtaanccgttagacgacaacggactacggaactacgttccgtaacggacccgtaaaccgaccgggtaccccttaagttttaaccttaaccgttggttaacccggtagggtaacggttaacggtttacgggttttaacccgggtcgggttaaccgttttttcccgggg

SEQ ID NO: 348678 - DNA, 626 bp, Homo sapiens
  misc_feature: GZ8MTXP01A4UUO.45.37.D04.1.454.CMB.2.raw
tcagacgcgatcgacacgaccggtgctcgatttagtagcatactgtttggggtttgggggcatcacccagcaaaccacatctgtcctctagagaatccccctgagagctccgttcctcaccatggactggacctggaggatcctcttcttggtggcagcagccaacaagagccccactcccaggtgcagctggtgcagtcgtggggctggaggtgaggaagccgtggggcctcgagtgaaggtctcctgcaggtcttctggctacaccttcgaccggcgactatcctccacgtgggtcgcgacgacggccccctggacgaagggcttggagtggagtgggattggactacaaccctaacagtggtacgacaacgaaaaactgtcgacaacgagtaacgtttcgagggtcgagggtacacgatacgacgaggacacgtcactcagacacgacgacctacgagtaggacgcgtagacgccgaaggacctagaacgtacgttaccgtacggaaccgaaccggttaacgggtacccttaagttttaacgttaccgttacggttggaccggtaaggtacgtttaacgggtttaccgggtcggttcggtttcggttttccgttttaacgggg

SEQ ID NO: 348679 - DNA, 713 bp, Homo sapiens
  misc_feature: GZ8MTXP01A31UR.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggacgccgtgggcctcgagtgaacggtcctccgtgacgaaggtcttcgtcggtacctacctacccgtaccgaccggcgtactactcctacccgacggtggtcgccgacgaccgccccgtaggaaccgtaagggtcgttggaggttaggaggtagggtacgtggtaactacccaaaacccccgtaaacgtaaggtacgggtacggaaccaaaacgtaaaacttcgtacgaacaaacggtaacggtaaacgtttacgggaacggggacgtaacggggtaccaaccgacgtacggaaccggaggaaacccgtaccggtacacgtaccgaacgaccgaacgtaccggacctaacggtagtacggacgaccgtagacgacgaacgtactacgaactacgttcgaacggacccgttaaccgacgttaccttaaacgtttagttagttccggagtaacggaggttaacgttacgggtttacgggcgttcgtttccgggtttttaaccg

SEQ ID NO: 348680 - DNA, 630 bp, Homo sapiens
  misc_feature: GZ8MTXP01EDUE9.45.37.D04.1.454.CMB.2.raw
  modified_base (370)..(370): a, c, t, g, unknown or other
  misc_feature (370)..(370): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcagtgaaggtctcctgcaaggcttctggctacacctcgaccggcgactatctccacgtgggtgcgacgacggcccctggacgaagggcttgagtggagtgggatggatccaaaccccctaacaagtggtggacaaacaaactntgacaacagtaagtttcgaggggtcacggggtacaaccgagtacgaaccgaggggaacctaccggttaccaatcgacgcaacgacgacctaacagtaggacgtcgtgagccgaaaggtacctaggaactacgtacgtaacggaaaccggttacgaaccgggttacctaaattttaacttaacgttggttacggaaccgggtaaggtaacgtttcggggtttaccgggttcgggtttccgtttcggggttttttaacccgg

SEQ ID NO: 348681 - DNA, 649 bp, Homo sapiens
  misc_feature: GZ8MTXP01BCO0L.45.37.D04.1.454.CMB.2.raw
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (309)..(309): a, c, t, g, unknown or other
  misc_feature (309)..(309): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaggtctctgcagctcngctacnctcacggcgactactctccagtgggtgcgacgcggcccctggacgaaggtctgnggtggagtgggatggactacctaaacccccgtaacgaagtgggtacggaccaaaaccgaaacttgtacggacaaaccgtaaggtaaacggtttcggaggggtacgtaacggggtacaaccgagtacgaaccggaagggaaccacgtaccacgcaagccaacgacgtacccgtaacgtaagtcgggacgacgtaggacgacgaacggactacggaactacgttcgaacgaaccggttacgacccggttaccttaattttaacgttcgttcgggttgtaacgggtagggtcgttttacgggttaccgggttcgggtttccgttttcggggtttttaacccgg

SEQ ID NO: 348682 - DNA, 614 bp, Homo sapiens
  misc_feature: GZ8MTXP01DEIXU.45.37.D04.1.454.CMB.2.raw
  modified_base (255)..(255): a, c, t, g, unknown or other
  misc_feature (255)..(255): n is a, c, g, or t
  modified_base (469)..(469): a, c, t, g, unknown or other
  misc_feature (469)..(469): n is a, c, g, or t
  modified_base (495)..(495): a, c, t, g, unknown or other
  misc_feature (495)..(495): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaagccgtggggcctcgagtgaaggtctcctgcaggcttcnggctaccacctcgaccggcgtactactcctccgacgtgggtcgaccgaccgtacggccccgtaggaccgaagggtctttggaggttggagttggggatagggactaccaaacccccttaagagtggggtacgacaaaccaaacttgtgaccaagtaagtaggtttacgaggggtcgagggtaccaccgagtacgaaccgagggacctacgacanacagcaacacgacctacagtgacgtnagacgacgacgactacgactacgtcgaacggaccgacgtacgttacgtttatttacgttacgttggttacgtaaggtagttaacggtttcggttacgggttcgttcgtttggttttccg

SEQ ID NO: 348683 - DNA, 728 bp, Homo sapiens
  misc_feature: GZ8MTXP01DQWM3.45.37.D04.1.454.CMB.2.raw
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccaacaagagcccactcccaggtgcagctggtgcagtcgtggggctgaggtgaggaagccgtggggcctcagtgaaggtctcctgcaggtcttcgtggctacacccttcgacccggcgacttactcctcccagttggggtcgccgtaaccgaccgggcccccgtaggggaaccgaagggggtcctttagggaggttgggacgttgggggaattcgggaacttacccccgaaaaccccgttaaacgaaggttcggggtacgggaaaccaaacctaaaccgttagtacggaacccaaaccgtaaagggttaacggtttacgggaacggggtaccgtaaggggttacccaaaccgagttaaccggaacccgaaagggggaacctaacggtacccacgtaaccgacgacctaacggaacggtacccttaaacgaacgtagggaacgtcgtacgaagaccgaagtaccgtaggaccagttccgacgaccggaaccttacggtaccttaagtttacgttacttggtaaggacgtaacggttgttcggtttacggtcggttcgttttaaccggg

SEQ ID NO: 348684 - DNA, 614 bp, Homo sapiens
  misc_feature: GZ8MTXP01AMR5T.45.37.D04.1.454.CMB.2.raw
  modified_base (298)..(298): a, c, t, g, unknown or other
  misc_feature (298)..(298): n is a, c, g, or t
  modified_base (352)..(352): a, c, t, g, unknown or other
  misc_feature (352)..(352): n is a, c, g, or t
  modified_base (375)..(375): a, c, t, g, unknown or other
  misc_feature (375)..(375): n is a, c, g, or t
  modified_base (441)..(441): a, c, t, g, unknown or other
  misc_feature (441)..(441): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaaggtctcctgcgaaggcttcgtggctacacctcgaccggcgactatctccacgtgggtgcgacncggccccgtggacaagggcttggagtggagtggatggatccgaaaccccctaanaagtgggtgacaaacgaaaactntcgacaacaagtaagtttcgaagggcagggtcacgagtcgacgtaggacacgtaccatcagcaacncgacctacagtgaagctgacgctagacctaggactacgtcgtcggaaccgaccgtaacccggttaccttaaagtttaactttccgttggttacggtccgggttaagggttaacgttttacggggtttaacccggggttcgggttcccggttttcgggtttttttaacccgggg

SEQ ID NO: 348685 - DNA, 612 bp, Homo sapiens
  misc_feature: GZ8MTXP01B7V5M.45.37.D04.1.454.CMB.2.raw
  modified_base (258)..(258): a, c, t, g, unknown or other
  misc_feature (258)..(258): n is a, c, g, or t
  modified_base (346)..(346): a, c, t, g, unknown or other
  misc_feature (346)..(346): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaggcttctggctacncctcaccggcgactatctccacgtgggtgcgacgacggcccctggacaagggcttggagtggagtgggatggatccaaaccccctaanaagtggtaggcaaacaaactgtgacacagtaagtttcgaggggcagggtcaaccgatacgaccgagggaccacggtccagtcacgcaacgacgaccgtaacagtacgggacgtcgtggaacgcgaaacggaccgttaggaacctagttccgtaacgaaccgaaccgtaccgggttacccttaaagttttacttaaccgttggttcggaaccggtagggtaacgtttcgggtttaccgggttgggtcgtttcgggtttttaacccgg

SEQ ID NO: 348686 - DNA, 607 bp, Homo sapiens
  misc_feature: GZ8MTXP01B32QI.45.37.D04.1.454.CMB.2.raw
  modified_base (287)..(287): a, c, t, g, unknown or other
  misc_feature (287)..(287): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctgggggcctcagtgaaggtctcctgcaaggcttctggctacacctcaccggcgactatctccactgggtncgacaggcccctggacaagggcttgagtggatgggatggatcaaaccccctaaacaaatggtggcaaaccaaaataagtgcaacagaaagtttcaaaggggcaaggggttcacccaatacgacgacgggaacgacgtaccactacacgacacacgaccgtaactaacgtaggacgacgtcgacgacgaacgacgtacgacgtaactcgtaacgaacgaaccgaaccggaccgtaaacgttttaactttaacgtttacgttacggtaacggtacggtaacgttacggtttaccgggttacgggttcggttcgggttttccg

SEQ ID NO: 348687 - DNA, 604 bp, Homo sapiens
  misc_feature: GZ8MTXP01EGO7S.45.37.D04.1.454.CMB.2.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (359)..(359): a, c, t, g, unknown or other
  misc_feature (359)..(359): n is a, c, g, or t
  modified_base (500)..(500): a, c, t, g, unknown or other
  misc_feature (500)..(500): n is a, c, g, or t
  modified_base (567)..(567): a, c, t, g, unknown or other
  misc_feature (567)..(567): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggagatcctcttcttggtggcagcagccacaagagcccactcccaggtgcagctggtgcagtcngggctgaggtgaggagcgtgggcctnagtgaggtctctgacaggcttcgtggctacaccttcaccggcgtactatctccacgtgggtgcgaccacggcccccgtaggaacgaagggtctttaggaaggtggagttgggataggactacccgaaaccctaanaaagtggtacggaacaactaactgtacgacaacgtaaggtaacgtttacgagggggctaaggggtaccaacgtagtacggaaccgaaggggaacctacggtacccaagtccgaagacacgacgggaactacgagtcgggancgtacgagaccgagacctagactagtcagacgtacgacggtacccttaattagttacttgtaacggngtaaggtgttcggttacggtcggttaacgttttcggg

SEQ ID NO: 348688 - DNA, 694 bp, Homo sapiens
  misc_feature: GZ8MTXP01A86G5.45.37.D04.1.454.CMB.2.raw
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggagccgtggggcctnagtgaggtctctgcaggcttcnggctacacctcgaccggcgactactctccacgtgggtcgcgacgacggccccgtggacgaagggcgttgaggtggagtgggatcggataccaaaccccctaacgaagtgggtacgacaaaacgtaaactgtacggactaaaccgaaggttaaacgtttcggaaggggtccgaacggggtaccaaccgtaagtacggaacccgaaggggaacccgtaccggttacaacgtaccgaaccgaccaaaccgaccggtacccgttaaagacggtacgggacgccgtaggacgcgaaacggtctagaacgtaacgttcgaacggaacccggacgtacccggttacctttaaagttttaacgttaccgttggttacggtaaccgggtaagggttaacgttttaccggggtttacccgggttgggtttaaccgtttttcggggtttttccccgg

SEQ ID NO: 348689 - DNA, 545 bp, Homo sapiens
  misc_feature: GZ8MTXP01AUF6Y.45.37.D04.1.454.CMB.2.raw
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (370)..(370): a, c, t, g, unknown or other
  misc_feature (370)..(370): n is a, c, g, or t
  modified_base (421)..(421): a, c, t, g, unknown or other
  misc_feature (421)..(421): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtggggcctgagtgaaggtctctgcaggtcttcnggctacncctcaccggcactatctccacgtgggtcgcgacacggccccgtggacgagggtcttgagtggatgggatggactacccaaacctaagagtggtacgaacaacgaactntcgacacgagtaagttcgagggcagggtcacagtcgacagggacacgtcancagcacgcggactagacgtggatcgtagacgacagtacctaggaacctatctacggacgaccgacgtctagtttaacttcttggaagcgtaaggtacgttcggttaccgtggttcgttttcggg

SEQ ID NO: 348690 - DNA, 612 bp, Homo sapiens
  misc_feature: GZ8MTXP01BJOTK.45.37.D04.1.454.CMB.2.raw
  modified_base (226)..(226): a, c, t, g, unknown or other
  misc_feature (226)..(226): n is a, c, g, or t
  modified_base (286)..(286): a, c, t, g, unknown or other
  misc_feature (286)..(286): n is a, c, g, or t
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
  modified_base (489)..(489): a, c, t, g, unknown or other
  misc_feature (489)..(489): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggagccgtgggcctnagtgagtctctgcaagcttctggctacacctcaccggcgactactcctccacgtcgggcnccgacgacggcccctggaaccgaagggtcttggagtggagttgggatggataccaaccccctaanaagtggtagaccaaacaaactntagacaacagtaagtttcgagggcgagggtcacagtacgaccgagggaccacgtacatcagcacacgacctaacgagtacggaagtccgagacgaccgaaggtacctagggaaccnttaccgaacggaacccgacgtaaaccggttcccttaagttttaacttaccggttgttacgggtcgtaaggggtaactttcgggtttacccgggttgggttccgtttcgggttttttaacccgg

SEQ ID NO: 348691 - DNA, 617 bp, Homo sapiens
  misc_feature: GZ8MTXP01DMCTB.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtgggcctcagtgaaggtctcctgcaggcttctggctacacctcaccggcgactactctccacgtgggtcgcgacgacggccccctaggaaaccgaagggcttggagttggagtgggatggataccaaacccctaacaagtggtacggaccaaacgtaaactgtgccaacgaggtaacgtttcgagggacgagggtcaccgagtacgaccgaagggacacgtcactcgagcaacgacgaccgttaacgagtagggacgcgtaggagcgaagacctggaacacgttcgaacggaaccgacgtaaccgggttcccttaaattttcgtttaacgttggttacggtcggtaaaggtcggttttcgggttaccgggttacggttcgttttccggggttttttcccg

SEQ ID NO: 348692 - DNA, 698 bp, Homo sapiens
  misc_feature: GZ8MTXP01EAB8O.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctcctgcaaggcttctggctacacctcaccggcgactactctccacgtgggtgaccgacgacggccccctgggaaccgtaagggtcttggaggtggagtgggatggactaccaaacccctaacgaagtgggtacgaccaaaacctaaaactgtacgaccaaaccgtaaggtaacgtttcgggaaggggtcaggggtaccaaccgtagtacggaaccggtaacgggaacctacccggtaccaagtccgaacgccaaacgtaccgaccggtaacgtaggttacgggacgtaccgtaggaacggtacgaaacgtacctaggacctaacgttccgtaacgggaaacccgaaccgtaacccgggttccttaaacgttttaacgtttaccgttgggttacgaacgggttaaaggtcggtttacggggtttacccgggttggtttccgtttcgggttttttaaccgg

SEQ ID NO: 348693 - DNA, 603 bp, Homo sapiens
  misc_feature: GZ8MTXP01AFHZK.45.37.D04.1.454.CMB.2.raw
  modified_base (285)..(285): a, c, t, g, unknown or other
  misc_feature (285)..(285): n is a, c, g, or t
  modified_base (447)..(447): a, c, t, g, unknown or other
  misc_feature (447)..(447): n is a, c, g, or t
  modified_base (496)..(496): a, c, t, g, unknown or other
  misc_feature (496)..(496): n is a, c, g, or t
  modified_base (510)..(510): a, c, t, g, unknown or other
  misc_feature (510)..(510): n is a, c, g, or t
tcagacgcgatcgacacgaccggtgctcgattttagtagcatactgttggggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagctggggctcagtgaggtctcctgcaaggcttctggctacaccttcaccggcgactatctccactggggtncgacagggccccctgggacaagggcttgaggtggagtgggggatggatccaaacctaaccgaagtgggtaggacaacgaaaaaaacctagtgacgaaactaaggtaacgtttcgaggggctaaggggtcaaccaagcgaacccgaagggaccacggtaccanccaagcaactagacccaacgagtagggagcctaggagacgacgttaacngtaactacgtccgnggaacgacgaccggtacttaagtttacgtacgttgttacggacggtaagttagtttccgggtttacggtggttcgtttcggttttcgttaagg

SEQ ID NO: 348694 - DNA, 710 bp, Homo sapiens
  misc_feature: GZ8MTXP01D74KP.45.37.D04.1.454.CMB.2.raw
  modified_base (251)..(251): a, c, t, g, unknown or other
  misc_feature (251)..(251): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtgggcctcagtgaggtctctgcaaggcttcgnggctacaccctcgaccggcgtactactcctccacgtgggtcgcgacgacggcccctggaacaagggtcttaggagtggagtgggatggactaccgtaaacccccctaacgaagtgggtacggaccctaaaaaccgtaaaacgtgtacgaccaaaccgtaaggtaaacggtttcggagggggtacccgtaaggggtaccaaccgaagtacggaaccgaaggggaacctaaccggtacccaagtcgaacgacaacgtacgaccctaacgagtagggacgaccgtaggaacggctaaacggtactacgaactacgttccgtaacggaacccgaaccgtacccggttaacctttaaagtttaacgtttaaccgttgggttacgggtaaccgggttaaaggttaacggttttaccggggtttaccggggttcggtttcggttttccgggttttttaaccccggg

SEQ ID NO: 348695 - DNA, 590 bp, Homo sapiens
  misc_feature: GZ8MTXP01AVVJU.45.37.D04.1.454.CMB.2.raw
  modified_base (347)..(347): a, c, t, g, unknown or other
  misc_feature (347)..(347): n is a, c, g, or t
  modified_base (369)..(369): a, c, t, g, unknown or other
  misc_feature (369)..(369): n is a, c, g, or t
  modified_base (449)..(449): a, c, t, g, unknown or other
  misc_feature (449)..(449): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctcctgcaaggcttctggctacacctcaccggcgactatctccacgtgggtgcgacacggccccgtggacgaagggcttgagtggatgggatggactacaaccccctaanagtggtcggacaaacgaaactntgacacagtaagtttcgaggggcagggtcacagtgaacgagggacacgtccatcagcactagcctacagtggacgtccgngacgcgtaacgacgtgaactaatcgtaacggaaccgaccgaccgggttacccgttaaattttacgttaaccgttgggttaccgaagggtaggttaacgttcgggtttaccgggttcggttcgttttcggtttttccccggg

SEQ ID NO: 348696 - DNA, 656 bp, Homo sapiens
  misc_feature: GZ8MTXP01EOLYM.45.37.D04.1.454.CMB.2.raw
  modified_base (327)..(327): a, c, t, g, unknown or other
  misc_feature (327)..(327): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagtagttgtttagacagcctaccaaacaataagaactactagcttaggaccagacaacgaaaccaggtcacgccctactaagctgcttctagtttacgnggctacgtacccgtacccgggaacgttcccggggtaccccctacggaccgtattcgaggttcgggaccgtgggtccgggtaccgtagggaactaggttactttaccaccttcctaccaacccgtataccgagccgacgtcccagccgtagggactaggaaacgtgtacggggtggtacttagttttactgcttggactatactaaatttatttaatttactaacctttcccgttacccggtaccgttttcccggacccggtttaacgggaaccgttaagggttgtaattaacgtaactaaaacggtacgttacgttaaggcgttaaccg

SEQ ID NO: 348697 - DNA, 673 bp, Homo sapiens
  misc_feature: GZ8MTXP01BC4G2.45.37.D04.1.454.CMB.2.raw
  modified_base (225)..(225): a, c, t, g, unknown or other
  misc_feature (225)..(225): n is a, c, g, or t
  modified_base (387)..(387): a, c, t, g, unknown or other
  misc_feature (387)..(387): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagcgtgggctnagtgaggtctctgacgaggtctcgtggctacacctcgaccggcgactatctccacgtgggtcgccgacgtacggccccgtaggacgaagggtcgttggaggtggagtgggatgggactaccaaacccccgtaaataaggtggtacggaccaaaactaaactntacgacaaacgtaggtaacgtttcggagggtaccgacgggtacaccgagtcggaaccgagggaacctacgtccacgtacgacgacaacgacgtacctaacgacgtacgggaacgtaccgtagaacgacgaacgtacgtacggaactacgttaccgaacggtaaccgaaccggtaaccggttactttaacgtttaacctttaggttcggttaggtaaccgggtaacgggttaagtttaccggggttttaccggttacggtttaacggtttttcgggtttttaacccg

SEQ ID NO: 348698 - DNA, 682 bp, Homo sapiens
  misc_feature: GZ8MTXP01B7307.45.37.D04.1.454.CMB.2.raw
  modified_base (241)..(241): a, c, t, g, unknown or other
  misc_feature (241)..(241): n is a, c, g, or t
  modified_base (329)..(329): a, c, t, g, unknown or other
  misc_feature (329)..(329): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctcctggctgtgtctcgtgggcgaggacgggccacatcaactgacaagtccagccagtagtgtttanacagctaccaaacaataaacgaactactagctaggtaccagacaagaaaccaggtcacgcctacctaagctagcttacctatttacgngggtacctacgttacccgtaacccggggtaacgttccccgggggtaccccctacggaccgtagtttacccgagggtacgggaccgtaaggggtccgggtcgtacgggggaactaggtactttcacttcctacaaccctgtacagcacgcctgaccaggtctaaggaacgtaggtgggtacggtacttaagtttcgtcgtcgttcggtacaaagtctaaagtttatttaactttaattaaccgtttcccggttacccgttaccgttttaccgggaaccccgttaaggggaaacccgttaaagttcggtaattaaaccgtaacgaaaacgtacggttcgtaacggctttaaccgg

SEQ ID NO: 348699 - DNA, 529 bp, Homo sapiens
  misc_feature: GZ8MTXP01A44GK.45.37.D04.1.454.CMB.2.raw
  modified_base (285)..(285): a, c, t, g, unknown or other
  misc_feature (285)..(285): n is a, c, g, or t
  modified_base (362)..(362): a, c, t, g, unknown or other
  misc_feature (362)..(362): n is a, c, g, or t
  modified_base (450)..(450): a, c, t, g, unknown or other
  misc_feature (450)..(450): n is a, c, g, or t
  modified_base (460)..(460): a, c, t, g, unknown or other
  misc_feature (460)..(460): n is a, c, g, or t
  modified_base (462)..(462): a, c, t, g, unknown or other
  misc_feature (462)..(462): n is a, c, g, or t
  modified_base (493)..(493): a, c, t, g, unknown or other
  misc_feature (493)..(493): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacacctcacggcgactatctccactgggtncgacacggcccctggacaagggcttgagtggatgggatggatcaaaccccctaacaagtggtggcaaaacaaacttngacaacagtaagtttcgagggcagggtcaccatagacgacggacgacgtaccactacacacacacgacgtacagtagagctgagacanactagacacncngacgacgacgacgtacttattacgttgttgngtaggtaagtcggttacggttcggtcgttcgtttcg

SEQ ID NO: 348700 - DNA, 605 bp, Homo sapiens
  misc_feature: GZ8MTXP01E0V5E.45.37.D04.1.454.CMB.2.raw
  modified_base (373)..(373): a, c, t, g, unknown or other
  misc_feature (373)..(373): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctctgcaaggcttctggctacaccctcaccggcgactatcctccacgtgggtgcgacgacggcccctggacgaagggtctggagtggagtgggatggataccaaaccccctaacaagtggtggacaaacaaactntgacaacgagtaagtttcgaggggacgagggtcacagtcgaccgagggaccacgtccatcagcaacacgacctaacgagtggagccgtaggacgacgaacggtaacctacggaactacgtcgtaacggaaccgaaccgaccgggttacctaaattttaacttacgttggttcggtaacggtagggtaacgtttacgggtttaccggttggttcgtttcgggtttttaacccg

SEQ ID NO: 348701 - DNA, 703 bp, Homo sapiens
  misc_feature: GZ8MTXP01A4U6S.45.37.D04.1.454.CMB.2.raw
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctgaggtgaggagccgtggggcctnagtgaggtctctgcagctcngctacactcgaccggcgactatctccacgtgggtcgcgacgacggccccgtggacgaagggtcgttgaggtggagtgggatggactaccgaaacccccctaacgaagtgggtacggaccaaaactaaaccgtaagtacgaaccaacgaacggtaaacggtttaccggaacggggtaccgaacgggggttaccaaccccgtaagttaccggaaacccggaacgggggaaacccgtaacccggttacccgaacgttaccgaacggaacctaaccgtaacggaacccctttaacgaacggttacgggaacgttaccgtaggaacgcgaaacgtaccgttacggaacctacgttccgtaacggaacccgaacgtaccgggaccttaagtttaacgttacgttggttacggaacggtaggtaacgtttcggttacggttcgtaacgtttcggttttaaccg

SEQ ID NO: 348702 - DNA, 691 bp, Homo sapiens
  misc_feature: GZ8MTXP01A33T3.45.37.D04.1.454.CMB.2.raw
  modified_base (288)..(288): a, c, t, g, unknown or other
  misc_feature (288)..(288): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagcgtgggcctcagtgaaggtctctgcaggcttctggctacacctcaccggcgactatcctccgacgtgggtcncggacgacggccccgtggaacgaagggtctttggacgtggagtgggagtcgggataccaaacccccgttaacaagttacggggtcggtaccaaaacgtaaaactcgttagaccaaacgtaacggtaaggttttacgaggggtaccgtaacggggttaccaaccgaacgtacggaacccggtaacgggggaaccctaaccggtaccctaactaccgaacggacctaacgaccgaccgttaacgaagttacgggacgaacgtcgacgacgaacgggtacttagaaccgtattcggtaacgaacggttacccgacggttcttaaacgtttacgttaacgttcggttacgaacgggtaggtaacgtttcgggtttacgggttcgttccgtttaacggtttttcccgg

SEQ ID NO: 348703 - DNA, 625 bp, Homo sapiens
  misc_feature: GZ8MTXP01BI521.45.37.D04.1.454.CMB.2.raw
  modified_base (256)..(256): a, c, t, g, unknown or other
  misc_feature (256)..(256): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctgagtgaacggtctcctgacaaggcttcgnggctactaccgtcaccggctactatcctccacgtgggtcgcgacgaccggccccgtaggacgaagggtcttggagtggatgggatggactacgaaaccccctaagaagtggtacgcaaaaacaactgtcgacgacgagtaacggttcgaggggtcagggtaccaacgtagtacgaaccgagggtaaccacgttacaatccaagacctaacgaccgaccctaagtacggtggacgtacacggacgacgaacgactacgacacttcggaacgacccgaaaccgtaccgttaccttaatttacgttacggttgacggtaaccgaaggttcgttacgggttaccggttcggttccgttttcgggttttaaccg

SEQ ID NO: 348704 - DNA, 706 bp, Homo sapiens
  misc_feature: GZ8MTXP01BO43C.45.37.D04.1.454.CMB.2.raw
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttcgtggctacaccttcgaccggcgactatctccagtgggtcgcgacgacgggccccctagggacgaaggggtcttggagtgggagtgggggattggaactaccaaaccctaaacgaagtgggtacggacaactaaaaaacctagtcgacaacgtaaggtaaacgtttcgaacggggcgtaacggggtaccaacgtagtacggaaaccgaacggggaacctaaccggttaccaacgtccgaacggacccaaacttaacggaccccttaacggagttacggggactaccgtagaacggccaaagaacccggttacgtaaccgtacgtaccgtaacggaaaccgtaaccgttaccggttaacctttaaagtttaacgttacgttcggttacggttacggtaagggttacgtttaacgggtttaccgggttcggttccggttttcggttttccgtttaacggg

SEQ ID NO: 348705 - DNA, 652 bp, Homo sapiens
  misc_feature: GZ8MTXP01ACPCS.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggacgccgtgggcctcgagtgaggtctctgcgaggtcttcgtggactactaccctcgaccggtcgactactcctccgacgtgggtcgccgacgaccggccccgtaggacgaagggtcttaggagtggagtggatggactaccaaacccccgtagtagtcggtacgacaaaacgtaactgtacgacaaagtagttaacggttacgacgggacgacgggtaccaaccgtagacggaaccgacgggtacaccgtacacgaccagactaaccgacgacccgtaagaacggtcgggaacgcgagacgacgtaacgtacgtacgtactacgtacgaaccgacgttaaccgtaccgttaacgtttaagtttacgttacggttggttacggtaaggttaggttaacggtttccgggttacggttcggtttcgttttcggtttaaccg

SEQ ID NO: 348706 - DNA, 688 bp, Homo sapiens
  misc_feature: GZ8MTXP01DNWJF.45.37.D04.1.454.CMB.2.raw
  modified_base (228)..(228): a, c, t, g, unknown or other
  misc_feature (228)..(228): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctnagtgaaggtctcctgcaaggcttctggctacacctcgaccggcgactatctccacgtgggtcgccgacgacggccccgtggaacgaagggtcgttggaggtggagtaggggtatagggactaccaaaacccccgtaacgaagtaggtcggacaaaactaaacctaagtacgaccgaaccgtaaaggtaaacggttttacggacgggggtacgaacggggttaccaaccgtaacgtaccggaaacccggaaagggggaaccctaaccggttacccgtaactacgaaccgaaccaaaccgaaccggtaaccctaaaccgtaagggtacggaacggacgtacggaacgacgttaacgacgttacgaacctactacgtaacgaaccggaaacgcggttacctaagttttacttacgttgttacgtcgagtgtttcggttacggttgtcgtttcgttttaaccgg

SEQ ID NO: 348707 - DNA, 733 bp, Homo sapiens
  misc_feature: GZ8MTXP01A1AYT.45.37.D04.1.454.CMB.2.raw
  modified_base (256)..(256): a, c, t, g, unknown or other
  misc_feature (256)..(256): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctgagtgaaggtctctgcagcttctgctacncctcgaccggcgactatcctccacgtgggtcgccgacgacggccccgtaggacgaacgggtctttggaggtgggaagtggggtagtaggactaaccaaaccccccgtaaagtaaagtcggggtaggaccctaaaacctaaaacgtaagtacgaaccgtaaacgtaaaggttaacgggttttacggaacgggggaccgtaccgggggttaacccaaccggtaacggttaccggaaccccggttaaacggggaaacccgtaacccggtaaccctaacgtccgaacgaccgaacgaccgtaccgtaacgtacggtacgggacgtaccgaggaacgacgaaacgtaccgagtaccaaacgttccgaacggaaccgacggtaccggttacccttaaagttttacgttacgttcggttacggtaagggtacgttaaggttaccgggtttacgggttcggtttcgtttcggtttttaacccggg

SEQ ID NO: 348708 - DNA, 704 bp, Homo sapiens
  misc_feature: GZ8MTXP01AUKOL.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgaggcggccaccatacaactgacaagtccagccaggtagttgtttagacagtacctacaaacaataaacgtaactaactagtcttacggtaccaagacaaacgaaaccgaggtcacggacctacctaagctgtactactatttacgtgggacctacgttacccggtaacccgggtaacggtccccggggtacccctacggtaccgtattccgacggttcgggacccgtaacggggtccgggtacgggtacggggaactacgggtaactttccgtaacccttcctacgaaaccctctaacgaaccggtccaacggtcctacgaacccgagggtacctaggaaacgtgttaggggtacgtagtttatttagtcggcttagtacgtaagtctaaatttactttaactatttaaccttcccttaccggttaaccggtttccggaacccggtagttaaaccggttagttacgaactttaagaaccgtaaacgtagttgttccgaacttcg

SEQ ID NO: 348709 - DNA, 582 bp, Homo sapiens
  misc_feature: GZ8MTXP01AYM49.45.37.D04.1.454.CMB.2.raw
  modified_base (247)..(247): a, c, t, g, unknown or other
  misc_feature (247)..(247): n is a, c, g, or t
  modified_base (289)..(289): a, c, t, g, unknown or other
  misc_feature (289)..(289): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaggtctcctgcaggcttcnggctacacctcaccggcgactatctccacgtgggtcgcgacncggcccctggacaagggcttggagtggagtgggatggactccaaaccccctaacaagtggtaggaccaaaactaaactgtcggacaacgtagtaacgtttcgagggacgaggggtcacgagtcgaccgagggaccacgtcatcagcacacgacctacgaagtggacgcgtagacgacgagcctagaacagtctaagaccgttacgaccggttacctaagttttacgttacgttgttcgtaacggtagtaacgtttcgggttacggttcggtaacgtttcggtttttaacccgg

SEQ ID NO: 348710 - DNA, 547 bp, Homo sapiens
  misc_feature: GZ8MTXP01CRKTB.45.37.D04.1.454.CMB.2.raw
  modified_base (143)..(143): a, c, t, g, unknown or other
  misc_feature (143)..(143): n is a, c, g, or t
  modified_base (352)..(352): a, c, t, g, unknown or other
  misc_feature (352)..(352): n is a, c, g, or t
  modified_base (367)..(367): a, c, t, g, unknown or other
  misc_feature (367)..(367): n is a, c, g, or t
  modified_base (400)..(400): a, c, t, g, unknown or other
  misc_feature (400)..(400): n is a, c, g, or t
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctnttcttggtggcagcagccacaagagcccactcccaggtgcagctggtgcagtctggggctgaggtgaggaagccgtggggcctcgagtgaaggtctcctgcaaggcttctggctacacctcaccggcgactactctccacgtgggtgcgacacggcccctggacaagggcttgagtggagtgggatggatcaaaccccctaagaatggnggacaaacaaaactnagcaacgagaagttcgagggcagggtacacagngaccgagggaacacgtacaatcgaagacacgacgcctaacgagtggaacgngngagagacgacgtacgactacgcgaacgacgacgacgacgtaattaattacgttgttgtgtagtaacgttcggttcggttcgttcgttcgtttcg

SEQ ID NO: 348711 - DNA, 585 bp, Homo sapiens
  misc_feature: GZ8MTXP01DAOY2.45.37.D04.1.454.CMB.2.raw
  modified_base (355)..(355): a, c, t, g, unknown or other
  misc_feature (355)..(355): n is a, c, g, or t
  modified_base (375)..(375): a, c, t, g, unknown or other
  misc_feature (375)..(375): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagccgtggggcctgagtgaaggtctctgcaaggcttctggctacacctcaccggcgactatcctccgacgtgggtcgccgacgacggcccccgtggacgaagggtcttggagttggatgggatggatccaaaccccctaanagtggtagaccaaacaaatntgacacaagtaacgtttcgagggcgagggtcaaccgagtcgaccgaagggaccacgtccatcagcacacgcctaacagtacggacgcgtgacgcacgactgacctatccgtaagaccgaacgaccggaccttaattttaagttaaccgttggttacggtaacggtaggtaatttcgggttacgggttcgttcgtttcggtttttaacccg

SEQ ID NO: 348712 - DNA, 605 bp, Homo sapiens
  misc_feature: GZ8MTXP01D03L3.45.37.D04.1.454.CMB.2.raw
  modified_base (503)..(503): a, c, t, g, unknown or other
  misc_feature (503)..(503): n is a, c, g, or t
  modified_base (540)..(540): a, c, t, g, unknown or other
  misc_feature (540)..(540): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttctggtggcagcagccacaagagcccactcccaggtgcagctggtgcagtcgtggggctggaggtgagggaacgccgtgggggcctcgagtgaaggtctcctgcaggcttctggctaccacctcaccggcgactatcctccacgtgggtcgcgacgacggcccctggacgaagggcttggagtggagtggagttggactaccaaacccccgtaataagtggtacggacaaaaccaaactgtgacgacaaggtacgtttaccgaggggccgtagggtacaaccgagtacgaacgacgggacaccgtaccagtcacacacgtacgacctaacgaggtacgacgcgacgacgacgaagacgtnaactactcgaacgacgaacgccggttacttacgtttnttaacgttgttcgaacggtaggtaacgtttcggttacgggttgttaacggtttcggttttaaccg

SEQ ID NO: 348713 - DNA, 682 bp, Homo sapiens
  misc_feature: GZ8MTXP01C23WK.45.37.D04.1.454.CMB.2.raw
  modified_base (246)..(246): a, c, t, g, unknown or other
  misc_feature (246)..(246): n is a, c, g, or t
  modified_base (379)..(379): a, c, t, g, unknown or other
  misc_feature (379)..(379): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtgggcctgagtgagtctctgcagctcngctacactcgacggcgactatctccacgtggtgcgacgacggccccgtaggacgaaggctggagtggagtgggatggaactaccgtaaaccccctaagaaagttggggtacggaccaaaaaactaaaacgttntacggaacctaaacgtaaagggtaacgtttcggaaacgggggtaccgtacgggtaaccaacccgtaagtaccggaaacccggtaagggggaaaccctaccggtaccaacgtaccgacgacctaacgacgtacctaacgagtacgggacgccgtagaacgacgaaacgtcgtaagactacgtaccgttaacgaaaccgacccggtaaacggttccctttaaagtttaaccgttacgttggttacggaacggtaaggttcgttccgggtttacgggttcgggtaacgttttcgggttttaaccgg

SEQ ID NO: 348714 - DNA, 614 bp, Homo sapiens
  misc_feature: GZ8MTXP01EWQWL.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagcgtgggcctcagtgaaggtctcctgcaaggcttctggctactacctcgaccggcgactatcctccacgtgggtcgcgaccgacggccccgtggacgaaggtcttggagtggagtggatggactaccgaaaccccctaacgaagtggtacgacaaaactaaactgtacgactaacgaagtaagtttcggagggtaccgagggtacaaccgtagacgaccgacgggaacaccgtacactcgacgacaacgacgacctagaggtcggaacgtccgaggacgacgacgaacgtcgactactcgtaacggaaccgaaccggtacgttaccgttaagtttattaccgttgttaggaacgtaggtcgtttcgggttaccggttggtccgtttcggttttaaccg

SEQ ID NO: 348715 - DNA, 587 bp, Homo sapiens
  misc_feature: GZ8MTXP01CMWHW.45.37.D04.1.454.CMB.2.raw
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (315)..(315): a, c, t, g, unknown or other
  misc_feature (315)..(315): n is a, c, g, or t
  modified_base (344)..(344): a, c, t, g, unknown or other
  misc_feature (344)..(344): n is a, c, g, or t
  modified_base (475)..(475): a, c, t, g, unknown or other
  misc_feature (475)..(475): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctctgcagctnggcacnctcgaccgcactatctccacgtggtcgcgacgacggcccctggacagggcgttgagnggatgggatggtataccccaacccctaanaagtggtggaacctaacaactagtcgacaacgtagtaagtttcggacgggtcgacgggtaccacgtagacggaaccgaggggaccctacggtccacgtcacgacacgacggcctaacgagtggaagtccgngacgacgagttaccgngaacncgttcgaacggacgaaaccggacgtacccgttatttacgttacgttgttcggcgtaaggtactttcgggttaccggtgttccgttttcggg

SEQ ID NO: 348716 - DNA, 720 bp, Homo sapiens
  misc_feature: GZ8MTXP01BTTLA.45.37.D04.1.454.CMB.2.raw
  modified_base (304)..(304): a, c, t, g, unknown or other
  misc_feature (304)..(304): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgaggacggccaccatcaactgacaacgtccagccagtagttgtttagacagcctaccaaacaataaacgaactactagcttacggtaccagtacaaacgaaaccnggtacacgccctactaacgctcgtctactactttacgtagggacctacgtaccgtaacccgggtaacgttccccggggtacccccgtacggaccgtagttccgaaggtcgggccgaacgggtccgggtacggtcgggaactaggttactttaccgaccttccctaccaacccatccgacgacgtaacggcctaggacgacggtacgtaggaaagtgttggggtcgtacgttagtttacgtcgccgttacggtagtaacgtaacttaaatttaagtttaactttaacttaaccgttttccccgttaccggtttaacccgtttccgggtaccccggttaagggaaaaccccgttagggttacggtaacttaacgtaaacggtaaaaccggtacgttcggtaacgggttccttaacccg

SEQ ID NO: 348717 - DNA, 685 bp, Homo sapiens
  misc_feature: GZ8MTXP01DA4TV.45.37.D04.1.454.CMB.2.raw
  modified_base (227)..(227): a, c, t, g, unknown or other
  misc_feature (227)..(227): n is a, c, g, or t
  modified_base (389)..(389): a, c, t, g, unknown or other
  misc_feature (389)..(389): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctnagtgaaggtctcctgcgaaggcttctggactacctacctcgaccggcgactactcctccacgtgggtgccgacgacggccccgtaggacgaagggtcttggagtggagtgggatggtataccgtaaaccccctaacgaagtggtacgaccaaaactaaactntaggacctaacgaaaggttaaacggtttcggacggggaccgtacggggtaccaaaccgtaagtacggaacccggaacggggtaacccaaccggttacccacgtacgaacgaccaaccgaccgaccgtaacgaggtacggacgacgtacggacgacgaagtacgtagaacctacgttccgaacggaaccggaacccgtacggttacttaaacgttttagttaaccgttggttacggtaacggtaggttaacggtttacggtttccgggttacggttcgtttcggtttttaacccggg

SEQ ID NO: 348718 - DNA, 565 bp, Homo sapiens
  misc_feature: GZ8MTXP01BZMZU.45.37.D04.1.454.CMB.2.raw
  modified_base (230)..(230): a, c, t, g, unknown or other
  misc_feature (230)..(230): n is a, c, g, or t
  modified_base (452)..(452): a, c, t, g, unknown or other
  misc_feature (452)..(452): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctnagtgaggtctctgcaggcttcgtggctacacccttcgaccggcgactactcctccacgtgggtcgcgaccgacgggccccctggaacgagggtctggagtggagtggatggactaccccaacctagagtggtgaacaactaactatgacacgagtagttcgaggcaggtacacgatacgaacgaggacacgtcatcgagcacgcgactagagtacggagcgngacgcgaagtactagactgtaacgtacggaccgaccgttaccggtacttaacttttacgttcggttgtcggtacgtaaggtcgtttcgggttaccggtggttcgttttccggg

SEQ ID NO: 348719 - DNA, 624 bp, Homo sapiens
  misc_feature: GZ8MTXP01D4SKA.45.37.D04.1.454.CMB.2.raw
  modified_base (228)..(228): a, c, t, g, unknown or other
  misc_feature (228)..(228): n is a, c, g, or t
  modified_base (287)..(287): a, c, t, g, unknown or other
  misc_feature (287)..(287): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagcgtggggcctnagtgaggtctcctgcaggtctctggctacaccttcaccggcactatctccacgtgggtncgacacggcccctaggacgaagggcttggagtggagttgggatggactaccgaaacctaacgaagtcgggtacggaaacaactaaacgtagtcgaactaacgaagggtaacgtttacggaaggggacgtaacggggttaccaaccgaaggttacggaaacccggtaaagggggaaccacgtacccaatacgaacgacaacgacggtacctaagagacggacgtcgtacgacgacgacgtacgacgactactaacgtacgacgacgacgtacttaactttacgttacgttagtggtacggtaacggtacggttacggttacggttcggttcggtttcg

SEQ ID NO: 348720 - DNA, 657 bp, Homo sapiens
  misc_feature: GZ8MTXP01AL2IY.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctctgcaggcttcgtggctacacctcgaccggcgactatcctccacgtgggtcgcgacgacggccccgtggacgaagggtcttggaggtggagtgggatggactaccgaaaccccctaacgagtgggtagaccaaaacaaactgtagaccaacgaggtaacgtttacggaacggggacgtacggggtaccaacccgagtacggaacccgaacggggaacccgaccggtaccaactaccgacgacctaacgacggaccctacgaagtcgggaacgcctaggacgacgaagtacctcggaactacgtcgtaacggaaccgaccgtaccggttaccttaacgtttacgttaacgttcggttacgtaacggtaggttaacgttcggtttacccggttagttaacgggttcgttttaaccggg

SEQ ID NO: 348721 - DNA, 657 bp, Homo sapiens
  misc_feature: GZ8MTXP01D68A5.45.37.D04.1.454.CMB.2.raw
  modified_base (260)..(260): a, c, t, g, unknown or other
  misc_feature (260)..(260): n is a, c, g, or t
  modified_base (518)..(518): a, c, t, g, unknown or other
  misc_feature (518)..(518): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggagatcctcttcttggtggcagcagccacaagagcccactcccaggtgcagctggtgcagtcgtggggctgaggtgaggaagccgtggggcctgagtgaaggtctctgcaaggcttcgtgctacnccttcgaccggcgactatcctccacgtgggtcgccgacgacggcccccgtaggacgaaggggtcttagggaggtggagtgggatggaactaccccgaaaccctaaacgtaagtcgggtaggaaaccaaactaaacgtatacgacaaacgtaagtaacggtttacgacgggtacgtacgggtacaaccgagtacgaaccgaagggacctaccgtcatacgagaccaacgaggtaccctaacgagtacgggacgtaccgnggaacgacgtaacgaccgtagactagttcgaacggaccgaacgaccggtaccttaagttttaacgttacgttacggtggtaccggtaagggttacggtttacgggtttacccgggttgggtttccgtttttaaccgggg

SEQ ID NO: 348722 - DNA, 569 bp, Homo sapiens
  misc_feature: GZ8MTXP01BL291.45.37.D04.1.454.CMB.2.raw
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (372)..(372): a, c, t, g, unknown or other
  misc_feature (372)..(372): n is a, c, g, or t
  modified_base (426)..(426): a, c, t, g, unknown or other
  misc_feature (426)..(426): n is a, c, g, or t
  modified_base (440)..(440): a, c, t, g, unknown or other
  misc_feature (440)..(440): n is a, c, g, or t
  modified_base (474)..(474): a, c, t, g, unknown or other
  misc_feature (474)..(474): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagcgtgggcctcgagtgaggtctcctgcagcttcgngctacncctcaccggcgactatctccacgtgggtgccgacgacggcccctggacgaagggtcttggagtggagtgggatggataccgaaacccccctaatagtgggtagaccaaactaaactntagacacgaagtacgtttcgagggcgagggtcacagtcgacgaggacacgtcancagcacacgctacngtggagcgtgacgcgacgacgtgaacctgtacgngaaccgacgaccggttaccttagtttacttacgttgttacggaacgtaggtcgtttcgggttaccggttggtaaccgttttcgggtttttaaccg

SEQ ID NO: 348723 - DNA, 628 bp, Homo sapiens
  misc_feature: GZ8MTXP01DUDZC.45.37.D04.1.454.CMB.2.raw
  modified_base (252)..(252): a, c, t, g, unknown or other
  misc_feature (252)..(252): n is a, c, g, or t
  modified_base (289)..(289): a, c, t, g, unknown or other
  misc_feature (289)..(289): n is a, c, g, or t
  modified_base (363)..(363): a, c, t, g, unknown or other
  misc_feature (363)..(363): n is a, c, g, or t
  modified_base (386)..(386): a, c, t, g, unknown or other
  misc_feature (386)..(386): n is a, c, g, or t
  modified_base (429)..(429): a, c, t, g, unknown or other
  misc_feature (429)..(429): n is a, c, g, or t
  modified_base (516)..(516): a, c, t, g, unknown or other
  misc_feature (516)..(516): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtgggctcagtgaaggtctcctgcaggcttcgngctacacctcaccgacgactactcctccagtgggtcnccgaacgccggcccccgtgggaaccgaagggtccttaggaggtggagtgggatggactaccaaacccccgtaanaagtggtagacaaaacgaaactntagaccacgaagtaacgttcgagggactacgggtacaccgtancggaaccgaaggggaaccaccggtaccaagaccgacgaccaacacgacctaacgaggtcggaagccgtagacgcgaaagtccgtaanactacgtaccgtaacgaaccgttacgtaccgttacgtttaaagtttacgttacgttggttacggaaggtacggttcggtttcgggttacggttcgttcggttttcggtttcg

SEQ ID NO: 348724 - DNA, 711 bp, Homo sapiens
  misc_feature: GZ8MTXP01APMSM.45.37.D04.1.454.CMB.2.raw
  modified_base (352)..(352): a, c, t, g, unknown or other
  misc_feature (352)..(352): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtggggcctcgagtgaaggtctcctgcaaggcttctggctactaccctcaccggcgactatcctccactgggtgcgacacggcccctggacaagggcttaggagtggagtggattggactacgaacccccctaanaagtgggtaggaccaaaactaaaacctgtacggaccaaacgtaacgtaaaggttttcccgaaggggtaccgtaacggggttaccaaaccgagtaccggaacccggaaggggaacccaacggttacccaagtccgaaagaccctaaacgtaccggaacccttaacgaggttacgggacggtacgtacggaacggtccgaaacggtaacccgttaggaaacctacggttacgttaacggaaacccggaccgtaaaccggttcccttaaagttttaacccgttaacgttgggttacggaaccggtaacggtaagtttaccgggttttaccggggttcggttcgtttcgggtttttaacccgg

SEQ ID NO: 348725 - DNA, 584 bp, Homo sapiens
  misc_feature: GZ8MTXP01ASLHP.45.37.D04.1.454.CMB.2.raw
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (263)..(263): a, c, t, g, unknown or other
  misc_feature (263)..(263): n is a, c, g, or t
  modified_base (265)..(265): a, c, t, g, unknown or other
  misc_feature (265)..(265): n is a, c, g, or t
  modified_base (335)..(335): a, c, t, g, unknown or other
  misc_feature (335)..(335): n is a, c, g, or t
  modified_base (411)..(411): a, c, t, g, unknown or other
  misc_feature (411)..(411): n is a, c, g, or t
  modified_base (550)..(550): a, c, t, g, unknown or other
  misc_feature (550)..(550): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagccccactcccaggtgcagctggtgcagtcgtggggctggaggtgaggagccgtggggctcgagtgagtctctgcagctngctacnctcacgcactancncagtggtgcgacgcggccctggacgaagggtctaggagtgggatgggataggactacaacctacagtggngacacaaaactgtgcaacgagtacgttcgacgggactagggtacacagtacgaaccgagggacctaacgtcctacncacgacaacacgaccctaacggagtcggacgacgagagacgacgtacgtacgaacgtactacgacggaaccgaacgacggtaccttagtttaacgttcgttacggttgcgggtaacggttagtttcggtttaccggggnggtttccggttttcggttttcccgttttaagggg

SEQ ID NO: 348726 - DNA, 607 bp, Homo sapiens
  misc_feature: GZ8MTXP01AS8EJ.45.37.D04.1.454.CMB.2.raw
  modified_base (254)..(254): a, c, t, g, unknown or other
  misc_feature (254)..(254): n is a, c, g, or t
  modified_base (379)..(379): a, c, t, g, unknown or other
  misc_feature (379)..(379): n is a, c, g, or t
  modified_base (462)..(462): a, c, t, g, unknown or other
  misc_feature (462)..(462): n is a, c, g, or t
  modified_base (476)..(476): a, c, t, g, unknown or other
  misc_feature (476)..(476): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctcagtgaaggtctcctgcaaggcttcgnggctacacctcaccggcgactactctccgacgtgggtcgccgacgacggcccctaggacgaagggtcttaggagtggagtgggatggactccaaacccctaacagtggagaccaaacaaacgttncgacaacgtagtaacgtttcgagggacagggtccaacgagtcgaccgagggtaccacgtacactcacgacacgacgccctaanaggtcggacgtcgngacgacgacgacgtacgactacgtacgaacgaacgaccgaccggttaccgttaacgtttaacttacgttacgttggtaaccggtacggtaagttcggtttaccgggttcggttcggtttcggtttttccgg

SEQ ID NO: 348727 - DNA, 532 bp, Homo sapiens
  misc_feature: GZ8MTXP01APSLB.45.37.D04.1.454.CMB.2.raw
  modified_base (249)..(249): a, c, t, g, unknown or other
  misc_feature (249)..(249): n is a, c, g, or t
  modified_base (344)..(344): a, c, t, g, unknown or other
  misc_feature (344)..(344): n is a, c, g, or t
  modified_base (364)..(364): a, c, t, g, unknown or other
  misc_feature (364)..(364): n is a, c, g, or t
  modified_base (448)..(448): a, c, t, g, unknown or other
  misc_feature (448)..(448): n is a, c, g, or t
  modified_base (468)..(468): a, c, t, g, unknown or other
  misc_feature (468)..(468): n is a, c, g, or t
  modified_base (497)..(497): a, c, t, g, unknown or other
  misc_feature (497)..(497): n is a, c, g, or t
  modified_base (517)..(517): a, c, t, g, unknown or other
  misc_feature (517)..(517): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcagcttntggctacacctcaccggcgactatctccacgtgggtgcgacacggccccgtggacgaagggcttgaggtggagtgggatggatcaaccccctaanaagtggtggcaaacaaactntgacacagtaagtttcgagggtcgagggtcaccgatcgaccagggacacgtccagtcagacacacgacctacagtcggagtcgngagcgacgacgtgactatcncgacgacgacggcctatttattacgttgngcgagtaagtggttaccggngtcgttcggttttcg

SEQ ID NO: 348728 - DNA, 537 bp, Homo sapiens
  misc_feature: GZ8MTXP01E164F.45.37.D04.1.454.CMB.2.raw
  modified_base (441)..(441): a, c, t, g, unknown or other
  misc_feature (441)..(441): n is a, c, g, or t
tcagacgcgatcgacacgaccggtgctcgatttagtagcatactgttgggtttgggggcatcaccccagcaaccacatctgtcctctagagaatccccctgagagctccgttcctcaccatggactggacctggaggatcctcttcttggtggcagcagccacaagagccccactccccaggtgcagctggtgcagtctggggctgaggtgaggaagcctgggggcctcagtgaaggtctcctgcaaggcttctggctacaccttcaccggcgactatctccactggggtgcgacaggccccctggacaaggggcttgagtggagtggggatggatacaaaccctaaccaatggtaggcaacaaaaactatgacacgagaagtttcgaggggcagggtcaccatgaccgagggacacgtcatcagcacagcctacatgganctgagcgagactgacatcgtgaacgacacggtccttatttattacttgttgcgaaggtattggttacggtcggttcgttcggtttcgttttaacgg

SEQ ID NO: 348729 - DNA, 681 bp, Homo sapiens
  misc_feature: GZ8MTXP01ASSC8.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagctgggcctcagtgagtctctgcaggctctggctacacctcaccggcgactatcctccacgtgggtgcgacacggcccctggacgaagggtcttggagtggagtgggggatgggaataccaaaccccccgtaacaaagtgggtacggaccaaaacaaacctaatgggaccaaccgaagtaacggtttcgacggggctaggggtccaacccgagtcggaaccgacggggaactacccggttactacgaccgaaacgccgttaaccgacggtacccgttaaccgaaggttacgggaacgttcccgaggacggtacccgaaggaccgttaccggaacgtaaccttcggtaaccggaaccgacccggaacggttccccggtttaaattttacgttaacggttcgttacggtaaccggtaagttcggttacggggtttaccggttacgggtttcgtttaacgggtttttcccg

SEQ ID NO: 348730 - DNA, 716 bp, Homo sapiens
  misc_feature: GZ8MTXP01D8N5Q.45.37.D04.1.454.CMB.2.raw
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (263)..(263): a, c, t, g, unknown or other
  misc_feature (263)..(263): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagtagccacaagagcccactcccaggtgcagctggtgcagtcgtggggctgaggtgaggagccgtgggctnagtgagtctctgnagcttngctacnctcacgcactactcnccacgtggtgcgacgacggcccctggacgaagggcttaggaggtggagtgggatggactacaaacctacgaagtgggtagaccaaactaactaagtcgaacaagtaacgttaaacgtttcggaaggggtacgaacggggtcaacccgtagtacggaacccgaagggacctaaccggtaccacgtacgacggacctaaaccgacgtaacccgttaccgaacggggttaggggaacgtaccgttacgggaacgtacccgaagtaccgttaacggaaccttacgtaccgtaaccgaaaccgggaaccgtaaacccgggttacctttaaggtttttaaacgttaacggtcggttacggttccgggttaagggttaaccggttttacgggtttaacccggggttcggtttccggttttacggtttttaacccggttttttaacggggaaccccggggg

SEQ ID NO: 348731 - DNA, 594 bp, Homo sapiens
  misc_feature: GZ8MTXP01CGR1P.45.37.D04.1.454.CMB.2.raw
  modified_base (293)..(293): a, c, t, g, unknown or other
  misc_feature (293)..(293): n is a, c, g, or t
  modified_base (324)..(324): a, c, t, g, unknown or other
  misc_feature (324)..(324): n is a, c, g, or t
  modified_base (415)..(415): a, c, t, g, unknown or other
  misc_feature (415)..(415): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgaccagtctccagacctccctggctgtgtctcgtgggtgagacggccacatcaactgacaagtccagccagtagttgtttagacacgactaccaaacaataacgaactactagctaggaccagacaagaaccnggtcacgcctacagctcgactctatttacgnggactactaccggtacccggacgtcccgggtcccctaggaccgtatcgaggtgacgtggcggtcgagggacagtacttcacttcacacctncagcagcctagcaggctaggaagtcgttggggtacgtcgttagtttagtcgactgtactaggtactaaatttagttactaacttcctttccgaccgtttacgttaccggcccgtttaagggaaacccgttaaagttcggtaaactacgttaaccgaaacttcggttgtaacgcgtaacg

SEQ ID NO: 348732 - DNA, 667 bp, Homo sapiens
  misc_feature: GZ8MTXP01C1Y7S.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgacaagtccagccagtagttgtttagacagactacaaacaaataaagaactactagtcttaggtaaccaagacaaacgaaaccgaggtacacgtccctactaacgctcgactactactttacgtcggactacgttacccgtaacccgggtacgtccccggggtacccctacggaccgtatccgaggtcgggacgtcggggtccgggtcgtacggggaactaggtactttcccaacttcctacaacctactacgacgaccgacgtcccgtagaccgaggagtagaaagtgtggggtagtacgtttaagttccgtgtcgtcgtatacgtaacttaatttattacttacttaaccgttcccgttacgttaccgttaccggtaccggtacggttaaaccgttaaggttacgtaactaacgtaacgtaaaacgtgttacggtaacgcgttaaccg

SEQ ID NO: 348733 - DNA, 561 bp, Homo sapiens
  misc_feature: GZ8MTXP01AX2ID.45.37.D04.1.454.CMB.2.raw
  modified_base (333)..(333): a, c, t, g, unknown or other
  misc_feature (333)..(333): n is a, c, g, or t
  modified_base (452)..(452): a, c, t, g, unknown or other
  misc_feature (452)..(452): n is a, c, g, or t
  modified_base (462)..(462): a, c, t, g, unknown or other
  misc_feature (462)..(462): n is a, c, g, or t
  modified_base (530)..(530): a, c, t, g, unknown or other
  misc_feature (530)..(530): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcaaggctcgtggctacacctcaccggcgaactatcctccacgtgggtcgcgacgacggccccgtggacgaagggtcttggagtggagngggatggataccaaacccccgtaacaagtgggtacgacaaaactaaactgtcgacaacgagtaacgtttcgacggggtacagggtacaaccgtatacggaaccgagggacaccgtcacncgacgcacgngacctacagtgagcgtgacgacagactgacagtcgaacgaagcgacgcgtaattattacgttgttcgngagtgtcggttacggcgtcgttcggtttccg

SEQ ID NO: 348734 - DNA, 700 bp, Homo sapiens
  misc_feature: GZ8MTXP01AIIHE.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggacgccgtgggcctgagtggaacggtctccgtgacgaggtcttcgtcggacctacctacccgtccgacccggcgtaacctactccctcccgacggtgggtcgaccgaccgaccggccccgtaggaacgaagggtcttggaggtggaggtggataggtactaccaacccctaagagtggtacgacaaaactaactgtcgacagtaaggtaacgttcggacgggcgagggtccaacgagtacgaccggaacggacaccgtaccagtcgacgacaaccgagtacccgaagtaggtcggaacgtccgtaggacgaccgtaacgtacgtacggtacctaacggttccgaacggaaccggttaaccgtacccgggttacctttaaagttttaaccggttacgttcgggttacgggtaaccgggttaaggtttccggtttaacgggggttcccgggtttaggttccgggtttttcccgggttttttaaccggg

SEQ ID NO: 348735 - DNA, 660 bp, Homo sapiens
  misc_feature: GZ8MTXP01CKMLF.45.37.D04.1.454.CMB.2.raw
  modified_base (637)..(637): a, c, t, g, unknown or other
  misc_feature (637)..(637): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtggaggaagccgtggggcctcgagtgaagtctctgacgagtcttcgtggcctacaccctcgaccggcgtactatcctccgaggttgggtcgcgaccgaccggcccccgtagggaaccgtaagggtcttaggacggtaggaggtggggatggactaccaaacccccctaagagtgggacgacaaaactaaactgcgacacgtagtaagttcgagggcgagggtacaccgtagtcggaaccgtagggacctaccgtaccgactaccgacgtaaccgaccacggaccctaacgtaaggtcggaaacgtcgtaacgacgtaccgaacgtaccgtgaactacgtccgtaacgaaccgcgtacccggttcttaaagttttattaccggttgttacgggaaccggtagttaacggttcggtttacccgggggttnttccgttttcgggttttaaccgg

SEQ ID NO: 348736 - DNA, 647 bp, Homo sapiens
  misc_feature: GZ8MTXP01APB9S.45.37.D04.1.454.CMB.2.raw
  modified_base (225)..(225): a, c, t, g, unknown or other
  misc_feature (225)..(225): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagagcccactcccaggtgcagctggtgcagtcgtggggctgaggtgaggagcgtgggctnagtgagtctctgcagctcgtggctacactcgaccggcgactatcctccacgtggtcgcgacacggcccctaggacgaagggtcttgacggtggagtgggtatggtaactaccgaaacccccctaagtagtgggtacggactaaaacaaactgtcgaccgtaagtaggtaacgtttcgggagggtacgtaacgggtaccaaccgtagtaccggaaccggaacgggacctaccggtaccaacgaccgaggacctaccgaaccggaccttaacgaggtacgggactacgtaggacgaccgagacctggacctactcgaacgaacgaccgtaccggttacttaaacgtttacttaccgttggttacgtaacggtaggtcgtttaccgggttacggttcggtttaaccgtttcgggtttttaacccg

SEQ ID NO: 348737 - DNA, 817 bp, Homo sapiens
  misc_feature: GZ8MTXP01EWRLT.45.37.D04.1.454.CMB.2.raw
  modified_base (256)..(256): a, c, t, g, unknown or other
  misc_feature (256)..(256): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaagccgtggggcctgagtggaaggtctcctgcaggtcttcgnggctacacctcgaccggcgactatcctccacgtgggtgccgacgacggccccgtggaacgaaggggtcttggaggtggagtacggggagtagggactaccgaaaaccccctaaacgtaaagtggggtacggaccctaaaacgtaaaacttgtacggacctaaaccgaaagggttaaacggttttaccgggaaacgggggtaccggtaacgggggttacccaaaccccggtaaacggttaccggaaaccccgggtaacgggggtaaacccctaacccggggtttaaccccaacgttacccggaaccggtaccgaaaccgtaaccgggtaaccccttaaaccgtaaaggggttacggggaacgtacccggtaaggaacggtaccgaaacggtaccgttaacgaaccgtaacgttccggtaacggaacccggttaaaccggtaccgggttacccttaaagttttaaccgttacggttcgggttacggtaaccggggtaggttaacggtttaccgggtttccggggttacgggtttccggtttttcggggttttttaaccccggg

SEQ ID NO: 348738 - DNA, 739 bp, Homo sapiens
  misc_feature: GZ8MTXP01CZ64V.45.37.D04.1.454.CMB.2.raw
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaagccgtggggcctcgagtgaaggtctccgtgacaaggcttcgtggctacaccttcgaccggcactatctccagtggtgcgacgcggccccgtggaacgaagggtcttaggagtacgggagtgggataggtaactaacccccgaaaacccgtaaacgtaagtacgggtacggaaaccaaaactaaacgttacgtacgaaccgtaaaccgtaaggttaaacgggtttcggaacggggtacgtaacggggttaccaacccggagttaaccgggaaccggaaacggggtaaccctaaccgggttacccaacgtaaccgaaccggtaccaacccgaacggggtaccccttaaaccgaacggttagggaaacgtccgtaaggaacggtaaccgaaggtaaccgttacggaactaacggttccgaacggaaccggtaaaccgaccggttaccttaattttacgttccgttggtaacggaggttaaggttaggtttaccgggtttacgggtcgttcgtttttaaccggg

SEQ ID NO: 348739 - DNA, 661 bp, Homo sapiens
  misc_feature: GZ8MTXP01AB6Q6.45.37.D04.1.454.CMB.2.raw
  modified_base (181)..(181): a, c, t, g, unknown or other
  misc_feature (181)..(181): n is a, c, g, or t
  modified_base (190)..(190): a, c, t, g, unknown or other
  misc_feature (190)..(190): n is a, c, g, or t
  modified_base (237)..(237): a, c, t, g, unknown or other
  misc_feature (237)..(237): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (607)..(607): a, c, t, g, unknown or other
  misc_feature (607)..(607): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtncagctggtncagtctggggctgaggtgaggagccgtgggcctcagtgaaggtctcngcagctcngctacnctcgacgcactatctcacgtgggtcgcgacgtacggccccgtaggaacgaagggtcttaggaggttaggaagtggggatggactaccgaaaccccctaacgaagtggtacggacaaaactaaacgtgtacggaacctaacgaaggttaacgttttcggaaacggggtccgtaacgggggttacccaaccggtaacgtaccggaaacccggacggggaaccctaccggtaaccacgtaccgaacgacgaaccgttacggacctaacgtagagggacgaccgtagacgacgaacgacgttacgactaactccggtaagaccgttacgaccggttaccgttaatttaaccgttgttcgngaacggtagttaacgttcgggttacggttcggttcgtttcggtttttaacccgg

SEQ ID NO: 348740 - DNA, 511 bp, Homo sapiens
  misc_feature: GZ8MTXP01BDSBJ.45.37.D04.1.454.CMB.2.raw
  modified_base (312)..(312): a, c, t, g, unknown or other
  misc_feature (312)..(312): n is a, c, g, or t
  modified_base (342)..(342): a, c, t, g, unknown or other
  misc_feature (342)..(342): n is a, c, g, or t
  modified_base (358)..(358): a, c, t, g, unknown or other
  misc_feature (358)..(358): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (431)..(431): a, c, t, g, unknown or other
  misc_feature (431)..(431): n is a, c, g, or t
  modified_base (486)..(486): a, c, t, g, unknown or other
  misc_feature (486)..(486): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctacaacaataagaactactagcttggtaccagcagaaaccaggtcagccctcctaagctgctcatttacngggcatcgtacccggaatccggggtccccngacgattcgagtggcngcgggtctgggacagatttcactctcaccatcagcagcctgcaggctagaagntgggngctagtttntgntgnagtactaattattattatcttccttccgtacgttccggtccgtaggaacgttagngaatagaacaagtcttgtcgcgtcg

SEQ ID NO: 348741 - DNA, 652 bp, Homo sapiens
  misc_feature: GZ8MTXP01B0IYO.45.37.D04.1.454.CMB.2.raw
  modified_base (349)..(349): a, c, t, g, unknown or other
  misc_feature (349)..(349): n is a, c, g, or t
  modified_base (370)..(370): a, c, t, g, unknown or other
  misc_feature (370)..(370): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctcgaggtgaggagcctggggcctcagtgaaggtctcctgcaaggcttctggctacaccctcaccggcgactatcctccacgtgggtgcgacgacggcccctggacaagggtcttggagtggagtgggatggatcaaacccccttanaagtggtggacaaacaaactntggaccacgagtaagtttcgagggggtccaggggtaccaaccgagtacggaccgaaggggaaccacggtaccagtacacgccacacgccctaacagttcgggaacgcgtagacgacctaaggaccttacggaactacgtaccgtaacggaaccggttaccgaacccgggttccttaaacgttttacgtttaacgttcggttacgggtaaccggtaaggggttaacgtttcggggttttaacccggggttcggttcccggttttcggggttttttaaccccgg

SEQ ID NO: 348742 - DNA, 891 bp, Homo sapiens
  misc_feature: GZ8MTXP01A9VDD.45.37.D04.1.454.CMB.2.raw
  modified_base (315)..(315): a, c, t, g, unknown or other
  misc_feature (315)..(315): n is a, c, g, or t
  modified_base (356)..(356): a, c, t, g, unknown or other
  misc_feature (356)..(356): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggtgaggacggccaccatcaactgacaacgtccagccaggtagttgtttaagacagtacctaccaaactaaataaagtaacttaactagtacgttacggtaaccagaccaaacgaaacccgnggtacaacgccctacctaagctgtacctactagtttaccgngggccaacgttcccggtaacccggggtaaacgtccccgggggtaccccctacggtaaccgtacttccgaaggtcgggaccgtaacggggtccggggttaccgtacgggggtaaactacgggttaactttacccgtaacccgttcccttaaccgaacccccttaagtaccccgaaacggttccccgaaaccgggtaccccggttcggtaaccgggaacggtaaccgttaaaggggaaaacgttaggtttccggggggtagggttaacccgttttaaaggtttttaaccggtttccgggttaattacccggggttaacctaaaggttaaacccgtttaaaagttttaaacgtttttaaacctttaacgtttttaacccctttacccccggtttacccgggtttaaaccccggttttccccgggtaacccccggtaagggggttaaaaccccgttaaagggggttaacttaaaccgtaaaccggttaacccgtaaaaaaccgggttaggttccgggttaaccggttcggttaaccccg

SEQ ID NO: 348743 - DNA, 687 bp, Homo sapiens
  misc_feature: GZ8MTXP01DCHXX.45.37.D04.1.454.CMB.2.raw
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
  modified_base (530)..(530): a, c, t, g, unknown or other
  misc_feature (530)..(530): n is a, c, g, or t
tcagacgcgatcgacacgaccggtgctcgatttagtagcatactgttggggtttggggggagagcatcacccagcaaccacatctgtcctctagagaatcccctgagagctccgttcctcaccatggactggacctggaggatcctcttcttggtggcagcagccacaagagcccactcccaggtgcagcgtggtgcaggtcgtggggctggaggtgaggagccgtggggcctgagtgaggtctcgtgacaggtcttcnggcctacnccttcgaccggctacgtactcctccgtacggtgggtcgccgaccgaccgggtccccgtaggaacgaaggggtcgttagggaggtgggtaggtgggaatggactaaccccgaaaccctaagaggtggtacggaaacaacgaactatagaacgaacgaggttaacggttacggaacgggtcgtacgggtaccaaccgtatacggaacccgaagggtaccaccgtacactacgacgacaaccgacggtaaccctaagacgaggganccgtagacggtaaccagtaaccgtacgaactagtaaccgtaacggaccggtaaacccgacgggttaacctttaagttttacgttaacggttcggttgggaacggttaacggttacgggtttacggtttccggggtcggtttaaccgggttttccggg

SEQ ID NO: 348744 - DNA, 682 bp, Homo sapiens
  misc_feature: GZ8MTXP01DIJ6V.45.37.D04.1.454.CMB.2.raw
  modified_base (370)..(370): a, c, t, g, unknown or other
  misc_feature (370)..(370): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagagcccactcccaggtgcagctggtgcagtcgtggggctggaggtggaggaacgccgtgggcctgagtgaacggtctcctgcaaggcttcgtggctacctaccctcgaccggcgaactactcctcctacgtgggtcgcgacgaccggcccctaggacgaagggtcttggagtggagtggatcggactaccgaaacccccgtaanagtggtacgacaaaacaaactgtagacgaaacgtaaggtaacgttacgaggggtcgacgggtacaacgagtacgacgaacgggaccacgtacactcagccaagacgacctaacgaggttaggacgtacgtagacgacgaaacgtactaggaaacctacgttccgtaacgggaaccgttaaaccgaaccgggttaacctttaacgttttaacgttaacgtttgggttaccgggtaacgggttaaaggttaacggttttaccggggttttacggggttacggtttcggtttttcggggtttttttaaccccggg

SEQ ID NO: 348745 - DNA, 618 bp, Homo sapiens
  misc_feature: GZ8MTXP01DF2HK.45.37.D04.1.454.CMB.2.raw
  modified_base (476)..(476): a, c, t, g, unknown or other
  misc_feature (476)..(476): n is a, c, g, or t
  modified_base (506)..(506): a, c, t, g, unknown or other
  misc_feature (506)..(506): n is a, c, g, or t
  modified_base (513)..(513): a, c, t, g, unknown or other
  misc_feature (513)..(513): n is a, c, g, or t
  modified_base (522)..(522): a, c, t, g, unknown or other
  misc_feature (522)..(522): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcaggtcgtggggctgaggtgaggaagccgtggggcctcgagtgaaggtctctgcaggcttcgtggctacaccttcgaccggcgactatctccacgtgggtgcgacacggccccctaggacgaagggtcttggaggtggagtggggatggaactaccaaaccctaacgaagtgggtacgacaaacgaaaaaactatcggacaaacgtaaggtaaacggtttccgaaggggtactaggggtaccaacccgtaagtacggaaccgaggggaacaaccgtaccatcgaacncaacacgacctacgagtggacgtgaggacntaagacngtacatccnggaacaacgacgtacttagtttattacgttgttgcggtaaggtcgtttcgggtttacccgggtgggttccgtttcgggttttccgttttaacgggg

SEQ ID NO: 348746 - DNA, 767 bp, Homo sapiens
  misc_feature: GZ8MTXP01CAN8T.45.37.D04.1.454.CMB.2.raw
  modified_base (256)..(256): a, c, t, g, unknown or other
  misc_feature (256)..(256): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaaggagtccgtggggcctcgagtgaaggtctcctgcaggcttcgngctacacctcgaccggcgactactctccacgtgggtcgcgacgacggccccgtaggaacgaagggtcttggaggtggagtgggggatagggactaccgaaaaccccccgtaagaagtgggtacggaccaaaacgtaaaactgtcggaacctaaaccgtaaggttaaacggtttcggaacgggggtacgtaacgggggttaccaaacccgttaagtaccgggaaaccgtaacgggggaaaccctacccgggttaccacgtaccgaacgggacccttaaacgaaccggtaccccgttaaacgacggttaggggtaacgcccgttaggaaccgagaaaccgggtacttacggaaccctagttcccggttaacgaaacccggttaccgaaacccgggttccctttaaacgtttttaagttaacccggttgggttacggtaaccgggttaaggtaacggtttttccggggtttaaccggggttcggtttccgggttttcggtttttttaacccggg

SEQ ID NO: 348747 - DNA, 701 bp, Homo sapiens
  misc_feature: GZ8MTXP01AOFS3.45.37.D04.1.454.CMB.2.raw
  modified_base (251)..(251): a, c, t, g, unknown or other
  misc_feature (251)..(251): n is a, c, g, or t
  modified_base (271)..(271): a, c, t, g, unknown or other
  misc_feature (271)..(271): n is a, c, g, or t
  modified_base (529)..(529): a, c, t, g, unknown or other
  misc_feature (529)..(529): n is a, c, g, or t
  modified_base (536)..(536): a, c, t, g, unknown or other
  misc_feature (536)..(536): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctctgcagctcngctacacctcgacgcgactntcctccacgtggtcgcgaccgacggcccccgtaggacgaagggtcttggacggttggacgtgggatcggaactaccgaaacccccctaaacgtaggtcggtacggaccaaaaccaaacttcgacgacctaaacgaaggttaacgttacggacgggtacgtacggggtaccaacccgtagcgaacccggaagggaccctaccggtccacgtaccgagacccgaacacgacccgttaacgacggttacggacgttacccngggaacnccgaaacgtacgtaggaacctaacttccggaacgaaccgttaccgtaacccgggttacctttaaagttttacggttaacgttcgggttacggtaaccggtaacgggtaagtttcccggggtttaaccgggttcgggtttcgttttaacccggggttttttcccgg

SEQ ID NO: 348748 - DNA, 648 bp, Homo sapiens
  misc_feature: GZ8MTXP01B961A.45.37.D04.1.454.CMB.2.raw
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
  modified_base (383)..(383): a, c, t, g, unknown or other
  misc_feature (383)..(383): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagcgtgggcctnagtgaaggtctctgcagctcnggctacacctcaccggcgactatcctccacgtgggtgccgacgaccggccccctagggaacgaaggggtcttaggaggtgggagtgggatggactaccaaaccccctaacaaagtgggtaggacaaaacgaaactntacgacaaacgagtaacgtttcggacgggacgacgggtaccaacgtacgacggaacccggaagggaaccctaaccggtaccaacgcgaacgaccaacgtaacgaccgtaactagtaggacgtaccgaggacgaccgaaagccttacggaactacgtcctaacgaaccgaaacgaccggttacttaaagttttaacttacgttggttacgtaaccggtaggttcgtttcggttacggttcggttaacgtttcggtttttaacccgg

SEQ ID NO: 348749 - DNA, 673 bp, Homo sapiens
  misc_feature: GZ8MTXP01ENJ88.45.37.D04.1.454.CMB.2.raw
  modified_base (364)..(364): a, c, t, g, unknown or other
  misc_feature (364)..(364): n is a, c, g, or t
  modified_base (391)..(391): a, c, t, g, unknown or other
  misc_feature (391)..(391): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtgggcctcagtgaaggtctctgcagcttctggctacacctcgaccggcgactatcctccacgtgggtgccgacgacggcccctagggaaccgaagggtctttaggagttaggagtgggggatgggaactaccgaaacccccctaanaagtcgggtacggacaaaaccaaactntgaccagaagtaagtttacggagggtacgagggtacaacgagtacgaacgaggacacgtaccagtacacgacaacgacgaccctaagagtacgggagtccgagacgacgaaacgcgttacggaacctagttccggtaacgaacccggaaccgtaacccgggttacccgttaaagtttttaacgtttaaccgttcggggttaggtaaccggttaaggttaacggttttcgggtttaacccggggttacgggtttcccggttttcggggtttttttaaccccgg

SEQ ID NO: 348750 - DNA, 805 bp, Homo sapiens
  misc_feature: GZ8MTXP01AU5V2.45.37.D04.1.454.CMB.2.raw
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtgggcctgagtgaggtctcctgcagcttcnggctacnctcnccggcactatcctccacgtgggtncgacncggcccctggacaagggcttgagtggagtgggatggactaccaaacccccctaagaagtgggtacggaccaaaaacctaaactaacgtacgaccgtaaacgtacgggttaaaacgttttccggaaacgggggtacccgaacgggggttacccaaaccccgtaaagggttacccgggaaacccggtaaacggggggaaaccctaaaccccgggttaccccgtaaactaccgaaaccggtacccgaaaccgaaccgggtacccccgttaaacggtacgggttaagggggtaaccgtacccggtagggaaacggtacccggtaaacggaacccgttcgggaaaacccttcggtttacccgtaaccgggaaaccccgttaccggtaaccccggttaccctttaaagtttttaaccgttaacccggttgggttaccgggaacggttaaacggggttaacgtttaccgggggttttaccggggttcggtttaaccggtttttaacgggttttttccccggg

SEQ ID NO: 348751 - DNA, 695 bp, Homo sapiens
  misc_feature: GZ8MTXP01DR7B9.45.37.D04.1.454.CMB.2.raw
  modified_base (380)..(380): a, c, t, g, unknown or other
  misc_feature (380)..(380): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggcgcagtctggggctggaggtgaggaagccgtggggcctcgagtgaaggtctcctgcaaggcttctggctacaccctcaccggcgactatctccaccgtgggtgcgacgaggcccccgtggaacaagggcttggagtggagtgggatggactacaaaccccctaacaaagtgggtcggacaaaacaaaactntagaccaaaccgtaagtaaacgtttcggaaggggccgaacggggttaccaaccgaacgtacgaacccgaaggggaacctaaccggtccaagtacacgacaacgacgacctaacaagtggaacgccgtaggacgacgaaacgacgtacgaaacgtacttccgtaaggaaccggaaaccgtacccgggttaacccgttaaatttttaacgtttaaaccgttcggtttagggaacccggttaaggggttaaccgttttacggggttttaacccggggttcggggttaaccgtttttccggggtttttttaaccccggg

SEQ ID NO: 348752 - DNA, 587 bp, Homo sapiens
  misc_feature: GZ8MTXP01DUND9.45.37.D04.1.454.CMB.2.raw
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagcgtgggcctnagtgaggtctctgcaggcttcgnggctacacctcgaccggcgactatctccacgtgggtgcgacgacggccccgtggacgaagggcttggagtggagtgggatggataccaaaccccctaacagtggtacgacaaaacaaactgtgacacgagtaagttcgagggcagggtcacgagtcgacgagggacacgtacatcgacgacaacacgacctaacgagtacggacgcgtgaacggcaaacgacgtacgactacgtcgtaacgaacgacaccggttaccttaagttttaacttacgttggttacgaacggtagtaacgtttacggttaccggttggttaaccgtttcggtttttaaccgg

SEQ ID NO: 348753 - DNA, 599 bp, Homo sapiens
  misc_feature: GZ8MTXP01D39MY.45.37.D04.1.454.CMB.2.raw
  modified_base (251)..(251): a, c, t, g, unknown or other
  misc_feature (251)..(251): n is a, c, g, or t
  modified_base (474)..(474): a, c, t, g, unknown or other
  misc_feature (474)..(474): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagcgtggtgcagtcgtggggctggaggtgaggagccgtggggcctcagtgaaggtctctgcagcttcnggctacacctcaccggcgactatctccacgtgggtcgcgacgacggccctggacaagggcttgagtggagtggatggataccgaaccccctaagtaagtggtaggacaaacaaactgtgacaacgtagtaacgtttcgagggacgacgggtacaaccgagtacgaccgagggaaccacgtaccacgtacagccaacgacgaccgtaacgaggtacgagtccgnggacgcaagacgtcggaactcgtcgtaagaccgaccgtacggttaccgttaatttacgttacgttgttggaacgtagggtaacgtttacgggttcggttcggttcgtttccgggtttttaaccgg

SEQ ID NO: 348754 - DNA, 830 bp, Homo sapiens
  misc_feature: GZ8MTXP01BC339.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtgggcctcgagtgaaggtctctgcaaggcttcgtggctactacctcaccggcgactatcctccacgtgggtcgaccgaccgacggtccccgtagggaacgaacgggggtcgttagggagggttaggggtacggtagggggtaacgttacggggtaaacttaacccccgtaaaaccccccccgttaaaaccggtaaaggttcgggggttacggggaacccctaaaaaaacccggtaaaaaccttcgtaacgggaaccctaaaccggtaaacgggtttaaaacgggttttacccgggaaacgggggtacccggtaaacggggggttaccctaaacccgtaaacgggttaccggggaaaacccccggtaaacggggggaaaccccttaaacccgggttacccctaaagtacccgaacgggacccaaacgttacccgggaacccctttaacggaaggttacgggacgttaccgaggacggcaaacgggactacgacctagtccgaacgaacccggaacgaccggttacttaaacgttttacttaccgttggttacgtaacgggaggttaacgttgggtttacccgggttggttccggtttccgtttttaaccgg

SEQ ID NO: 348755 - DNA, 644 bp, Homo sapiens
  misc_feature: GZ8MTXP01AMP6S.45.37.D04.1.454.CMB.2.raw
  modified_base (287)..(287): a, c, t, g, unknown or other
  misc_feature (287)..(287): n is a, c, g, or t
tcagacgcgatcgacacgaccggtgctcgatttagtagcatactgttggggtttgggggcatcacccagcaaccacatctgtcctctagagaatcccctgagagctccgttcctcaccatggactggacctggaggatcctcttcttggtggcagcagccacaagagccccactccccaggtgcagctggtgcagtctggggctgaggtgaggagcctggggcctcagtgaggtctcctgcaagcttctggctacaccttcaccggcgactatctccactggggtcncgacacggccccctggacaagggcttggagtggagtggggatgggataccgaaaccctaacaagtgggtcggaccaacaaaaactatcggacaaccgaaggtaacgttttcggaacggggtacgacggggttaccaccgtaagacggacccgaaaggggacccaacggtacccaatccgaacgaccgaacaacggaccttaacgagttaggggaacgtaccgagggacgcgaacggtaacccgtaggacctacgtccgacggaaccgaccgacggtacccttagttttaactaacgttggttcgcggtaaggtcgttcgggtttaccggtggttcgtttcggtttccgttttaacgg

SEQ ID NO: 348756 - DNA, 570 bp, Homo sapiens
  misc_feature: GZ8MTXP01B0CHX.45.37.D04.1.454.CMB.2.raw
  modified_base (248)..(248): a, c, t, g, unknown or other
  misc_feature (248)..(248): n is a, c, g, or t
  modified_base (363)..(363): a, c, t, g, unknown or other
  misc_feature (363)..(363): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagccactcccaggtgcagctggtgcagtctggggctgaggtgaggaagcctggggcctcagtgaaggtctcctgcaaggtttcnggctacaccttcacccggcgactatctccactgggtgcgacacggccccgtggacgaagggcttggagtggagtgggatggactcaaaccctaacagtggtggacaacaactaangcacagtaagttcgaggggcgagggtccacgatcgaccgagggacacgtccatacagcacacgacctacaggttcgaggctagacgccgaagactacgacgtagtccgtagacgaaccacgggttactaacttttagttacgtgttagcggttagtaagttggtttaaccggtggtcgtttacggtttcgtttttaacggtaaccgg

SEQ ID NO: 348757 - DNA, 653 bp, Homo sapiens
  misc_feature: GZ8MTXP01DM8UY.45.37.D04.1.454.CMB.2.raw
  modified_base (255)..(255): a, c, t, g, unknown or other
  misc_feature (255)..(255): n is a, c, g, or t
  modified_base (359)..(359): a, c, t, g, unknown or other
  misc_feature (359)..(359): n is a, c, g, or t
  modified_base (574)..(574): a, c, t, g, unknown or other
  misc_feature (574)..(574): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggagatcctcttcttggtggcagcagccacaagagcccactcccaggtgcagctggtgcagtcgtggggctggaggtgaggaagccgtggggcctgagtgaggtctctgacaggtcttcgnggctacaccttcgaccgcgactatctccagtgggtcgcgacgacggcccctaggacgaagggtcttggaggtggagtgggatggactaccccgtaaaccctaanaagttgggtacggaaccaaactaacgtagtacgaccaacgtaaggttaaacggtttcggaacggggtcgtaaggggttacccaaccgtaagtcggaaacccggaaggggtaacccgtaaccggtaccctaacgaccgaacggaccgaacccgacggtaaccccgttaacgaagttacgggacgaccgttaggacgacgaacgtacgttacgaacngtaacgtacgaacgtacgacggtaccttagtttacgttcgttagtgagtaagttcgtggttaccgtggttcgttttcgg

SEQ ID NO: 348758 - DNA, 688 bp, Homo sapiens
  misc_feature: GZ8MTXP01BQNTO.45.37.D04.1.454.CMB.2.raw
  modified_base (181)..(181): a, c, t, g, unknown or other
  misc_feature (181)..(181): n is a, c, g, or t
  modified_base (250)..(250): a, c, t, g, unknown or other
  misc_feature (250)..(250): n is a, c, g, or t
  modified_base (280)..(280): a, c, t, g, unknown or other
  misc_feature (280)..(280): n is a, c, g, or t
  modified_base (622)..(622): a, c, t, g, unknown or other
  misc_feature (622)..(622): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttctggtggcagcagccacaagagcccactcccaggtnccagctggtgcagtcgtggggctggaggtgaggagcgtggggcctgagtgagtctcctgcaggcttcgnggctactacctcgaccggcgtactagtccnccgtacgtgggtcgcgacgaccggcccctaggaacgaagggtcttggagtggagtgggatggtactacctaaaccccctaagagtcgggtaggaccaaaactaaacttgtcgaccaacgtaggtaacggtttacgaggggtacgtacgggtaccaaccgtagaccggtaccgagggtaccaccggttcaactcgaagaccaacgaccgtaccgtaacgtagtcgggacgtcgaaggcgaaccgtaaggtaccgtcgaacgttacgtccgtaacggtaacccggaacggtacccgttaccgttaaagttttaattacccggttgggttacgtaacccggggtnttaaccggggtttccggttttaccggggttcggttcccggttttaaccgggtttttttaacccggg

SEQ ID NO: 348759 - DNA, 828 bp, Homo sapiens
  misc_feature: GZ8MTXP01B465V.45.37.D04.1.454.CMB.2.raw
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgaggtgaaggtctcgtgacaggtctcgtggctacaccttcgaccggcgactatctccgacgtgggtcgcgaccacggcccctaggaacgtaagggtcttaggaggtggagtgggatggaactaccccgaaaccctaagaagtcgggtacggaaccaaacgtaaacgtagtacggaactaacgaaaggttaacggtttcgaaacggggtaccgtaacggggtaccaacccgtaagtaccggaaacccggaaacgggggaaccctaaccggttacccaaagtacccgaaacggtacccgaaacccgaacgggaaccccgttaacgaacggttacggggaacgtacccggttaaggaaaccggtaaccggaaacggtaacccgttacgggaaaacccctcgtttaacccggtaaccgggaaaccgggtaaaccccgttaaacccggggttaacccctttaaagttttttaaaccgtttacccgggttagggttaacggggtacccggggttaaaggggttttaacccgggttttaccgggggttttttaacccccgggggttaacgggggtttttccccgggttttttttaacccggggg

SEQ ID NO: 348760 - DNA, 627 bp, Homo sapiens
  misc_feature: GZ8MTXP01AWFYK.45.37.D04.1.454.CMB.2.raw
  modified_base (243)..(243): a, c, t, g, unknown or other
  misc_feature (243)..(243): n is a, c, g, or t
  modified_base (382)..(382): a, c, t, g, unknown or other
  misc_feature (382)..(382): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggagatcctcttcttggtggcagcagccacaagacgcccactcccgaggtgcagctggtgcagtcgtggggctggaggtgaggagccgtgggcctgagtgaggtctcgngcgaggtcttcgtggctacaccttcgaccggcgactatcctccacgtgggtcgccgacgccggccccgtggaacgaagggtctaggagtggagtggagtggactaccccgaaacctaagagtggtacgaacaacaagtntagacaacgtagtaacgttcgagggtacgacgggtacaacgagtacgaacgaacggtaccacgtaccatacgacgaccgacgacgggtaccctaaggagtacgggacgtccgaggacgacgacgtacgtacggacctagtaacgtacggaaccgtaaccgttaccggtaacttaagtttacgttcgttcggtaacggtacggtaaggttacgttacgggttaccggtcggttcgttttaaccggg

SEQ ID NO: 348761 - DNA, 629 bp, Homo sapiens
  misc_feature: GZ8MTXP01BCK6S.45.37.D04.1.454.CMB.2.raw
  modified_base (247)..(247): a, c, t, g, unknown or other
  misc_feature (247)..(247): n is a, c, g, or t
  modified_base (524)..(524): a, c, t, g, unknown or other
  misc_feature (524)..(524): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagcgtggtgcagtcgtgggctggaggtgagagcgtgggcctgagtgagtctctgcagcttcgnggctacacctcgaccggcactactcgtccacggtggtgaccgacgaccggcccgtaggacgaagggtcttggagtggagtgggataggactaccgaaacccccctaagagtggtacggaccaaacgaaaattgacgacaacgaagttacggttacgagggaccgagggtacaacgagtacgaacggaggtaccacggtccagacgacgacaacgtaccgaccgttaagaggcggagcgtcgaacgacgaacgactacggactacgttacccggtaanaacccggaacgtaccggttaccttaagttttaacgttaccgttggacgtaacggtagttaacgtttcgggttacggttcgttccggttttcggtttttaacccgg

SEQ ID NO: 348762 - DNA, 669 bp, Homo sapiens
  misc_feature: GZ8MTXP01AQ5PU.45.37.D04.1.454.CMB.2.raw
  modified_base (248)..(248): a, c, t, g, unknown or other
  misc_feature (248)..(248): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctggaggtgaggacgccgtgggcctgagtgagtctctgcagcttcnggctacacctcgaccggcgtactactcctccgacgtgggtcgaccgacgaccggcccccgtaggaccgaagggtcttggagtggagtgggatggactaccaaaccccctaagagtggtacggacaaaactaaactgtacgacaaacgtaaggtaacgtttacggaggggaccgaacgggttacccaaccgtagtacggaaccgaacgggacctaacgtaccaactacgacgaacacgacgaccttaacgaggtacggacgtccgtaagacgacgaacggtaccttaggaacctacgttacgtaacgaaccgggacgtaaccggttacccttaaaggttttaacttacgggttggttacggtaaccggtaggtaacggtttaccggttacgggttcggttaacgtttcggtttttaacccgg

SEQ ID NO: 348763 - DNA, 651 bp, Homo sapiens
  misc_feature: GZ8MTXP01DSRK0.45.37.D04.1.454.CMB.2.raw
tcagacgcgatcgacacgaccggtgctcgattttagtagcatactgtttggggtttgggggcatcacccagcaaccacatctgtcctctagagaatccccctgagagctccgttcctcaccatggactggacctggaggatcctcttcttggtggcagcagccacaagacgcccactcccaggtgcagctggtgcagtcgtggggctggaggtgaggagccgtggggcctgagtgaggtctcctgcaggtctctggctacacctcacggcactatctccacgtggtcgcgacacggcccctaggacgtaaggtctaggagtgggagtgggatcggactaccgaaccctaacgaaggtggtacgacaaacgtaaaactatcgacaacgtaacgtaagttcggagggacgtacgggtacacgagtcggaaccgaggacacgtcataccagaccactacgacctacgaggtagggacgacgtagacgacgaacgtactacgtaacgtactaccgtaacggaaaccgaaccgttacggtacccttaaagttttacgttacgttacggttcggttaccgggtaaggttacggtttccgggttttaccggggtcgggtttaccgtttttaaccgggtttttcccggttttaaccggg

SEQ ID NO: 348764 - DNA, 645 bp, Homo sapiens
  misc_feature: GZ8MTXP01EGV7L.45.37.D04.1.454.CMB.2.raw
  modified_base (564)..(564): a, c, t, g, unknown or other
  misc_feature (564)..(564): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaaggtctccgtgacgaaggtcttcgtggctaccacccttcgaaccggcgacttactcctccgacgtgggtcgccgaacgacgggccccctagggaccgaaggggtcgttaggaggtggaagtgggggattgggaatacccgaaacctaaacacgtgggtacggactaacaaaaaacctatcggacaaacgaaggtaacgtttacggacggggtacgagggtaccaacagtaccggaaccgaacggggaccaaccggttacccagaccgaacgaccaacgtacgacccttacggtaagtggtaagcgtagacgcagtactgacatcgtgaaccncgaacgcttaatttagtcacggttgacgtaaggtacgttcgggtttaccgtgggttccgtttcggttttccgtttaacggg

SEQ ID NO: 348765 - DNA, 746 bp, Homo sapiens
  misc_feature: GZ8MTXP01EIYTV.45.37.D04.1.454.CMB.2.raw
  modified_base (254)..(254): a, c, t, g, unknown or other
  misc_feature (254)..(254): n is a, c, g, or t
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagcccactcccaggtgcagctggtgcagtcgtggggctgaggtgaggaagccgtggggcctcgagtgaaggtctcctgcaggcttcgnggctacaccttcgaccggcgactactctccacgtggggtcgccgaccgaccgggtcccccgtagggaaccgaaggggtcttaggaggtgggagtggggattagggaactaccgtaaaacccctaaacgtagtggggtacggaccaaacgtaaaaaactacgtcggacctaaacgtaaagggttaaacggtttcggaacgggggtcgtaacggggtacccaacgtaaggtaccggaaccggaacgggacctaaccggtcctaaactaccggaagaccctaaacgaacggtacccttaacggaggttaggggaacgtccgaggacgaccgaacggaacctacggaactacgttaccgaacggtaaaccgaccgttaaccggtacctttaaagtttaacgttacgttaggttcggttacggtaagggttacgttttaaccgggtttaaccgggtcggtttaccggttttcgggttttaaccgtttttaaccgggg

SEQ ID NO: 348766 - DNA, 606 bp, Homo sapiens
  misc_feature: GZ8MTXP01CCQ8G.45.37.D04.1.454.CMB.2.raw
  modified_base (343)..(343): a, c, t, g, unknown or other
  misc_feature (343)..(343): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtgggcctcagtgaggtctctgcaaggcttctggctacacctcacggcgactatctccacgtgggtgcgacgacggcccctggacaagggcttggagtggagtgggatggataccaaacccccctaanaagtgggtacggaccaaacaaactgtacgacaacgaagtaagtttcgaaggggtcgtagggtaccacgagtcggaaccgaggggacaccggtccataccagaccacgacgaccgtaacgtagtcgggactccgaagacgcgaacgtactacggactactccgtaagaaccgacgtaccggacttaacgttttacttacgttgttacggtaaccggtaggtaacgtttcggtttacggttggttccgtttgggtttttaacccg

SEQ ID NO: 348767 - DNA, 606 bp, Homo sapiens
  misc_feature: GZ8MTXP01CLEA4.45.37.D04.1.454.CMB.2.raw
  modified_base (227)..(227): a, c, t, g, unknown or other
  misc_feature (227)..(227): n is a, c, g, or t
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctnagtgaaggtctcctgcaaggcttctggctacacctcaccggcgactatctccactgggtgccgacgacggcccccgtggacgaagggtcttggaggtggagtgggatggatcaaccccctanagtggtgacaaacaaacgtntgacacgagagtttcgaggcgagggtcacagtcgacgagggacacgtcatacgagacacacgacctacagtggaacgtcgagacgacgtaacgacgtcgacctatcgtaacggaacgttaccgtaaccgggacccttaaagttttacgttaaccgttggttacgggtccggtaaagggttaacgtttccggggttttaaccgggttcgggttccgtttcggggtttttttaacccgg

SEQ ID NO: 348768 - DNA, 547 bp, Homo sapiens
  misc_feature: GZ8MTXP01DO8AF.45.37.D04.1.454.CMB.2.raw
  modified_base (353)..(353): a, c, t, g, unknown or other
  misc_feature (353)..(353): n is a, c, g, or t
  modified_base (369)..(369): a, c, t, g, unknown or other
  misc_feature (369)..(369): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccacatcaactgacaagtccagccagagttgtttagacagctaccaaacaataagaactactagcttggtacagacaagaaacaggtcacgcctactaagctgctactatttacgtggcataccgtaacccgggaatcccggggtccccngacgtattcaggtgcnggcggtcgtagggacagtacttcactctacaccatcagcacgcctgcagctagaagatggggcgtatagtttagtgcttgctaagatatatatgtaagtacttctcttcgtacgttcggttacggacgggttacgtaacggtaggtaacggtactacgaaacgtaacgttaacgtcgg

SEQ ID NO: 348769 - DNA, 546 bp, Homo sapiens
  misc_feature: GZ8MTXP01DQLL9.45.37.D04.1.454.CMB.2.raw
  modified_base (228)..(228): a, c, t, g, unknown or other
  misc_feature (228)..(228): n is a, c, g, or t
  modified_base (344)..(344): a, c, t, g, unknown or other
  misc_feature (344)..(344): n is a, c, g, or t
  modified_base (366)..(366): a, c, t, g, unknown or other
  misc_feature (366)..(366): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (443)..(443): a, c, t, g, unknown or other
  misc_feature (443)..(443): n is a, c, g, or t
  modified_base (467)..(467): a, c, t, g, unknown or other
  misc_feature (467)..(467): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagcgtggggcctnagtgaaggtctctgcaggctctggctacacctcaccggcgactatctccacgtgggtgcgacgacggcccctggacgaaggcttgagtggagtggatggactccaaaccccctaanaagtggtagacaaaacaaactngacaacgagtaagtttcgagggcgacgggtcaaccgagacgaaccgagggacaccgtcancancacacacctagagnggagcagagcgaagactgacaacncaacgacgacgacgttacgtacttaattacgttgttgaagtaggtaacgttcggttacggttcggttcgtttcgtttcg

SEQ ID NO: 348770 - DNA, 606 bp, Homo sapiens
  misc_feature: GZ8MTXP01AQJYW.45.37.D04.1.454.CMB.2.raw
  modified_base (355)..(355): a, c, t, g, unknown or other
  misc_feature (355)..(355): n is a, c, g, or t
  modified_base (374)..(374): a, c, t, g, unknown or other
  misc_feature (374)..(374): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctcctgcaaggcttctggctacacctcaccggcgactatcctccacgtgggtcgcgacgacggccccgtggacgaagggtcttggaggtggagtgggatggataccaaaccccctaanagtggtgacaaacaaactntgacagagtaagtttcgagggcagggtcacgagtcgaccgaggaccacgtacagtcagcaacacgacctacgagtcggacgtcgaggacgacgaagacgtacgactacgttcgtaacggaaccgaccggtaccggttacccttaaagttttacgttaacgttggttaggtccggtaagggtaacgtttcgggtttacgggttcggttccggttttcgggtttttaacccggg

SEQ ID NO: 348771 - DNA, 649 bp, Homo sapiens
  misc_feature: GZ8MTXP01CJE51.45.37.D04.1.454.CMB.2.raw
  modified_base (409)..(409): a, c, t, g, unknown or other
  misc_feature (409)..(409): n is a, c, g, or t
  modified_base (526)..(526): a, c, t, g, unknown or other
  misc_feature (526)..(526): n is a, c, g, or t
tcagacgcgatcgacacgaccggtgctcgattttagtagcatactgttgggtttgggggcatcacccagcaaccacatctgtcctctagagaatccccctgagagctccgttcctcaccatggactggacctggaggatcctcttcttggtggcagcagccacaagagccccactccccaggtgcagctggtgcagtcgtggggctgaggtgaggaagcgtggggcctcgagtgaaggtctcctgacgaaggtcttcgtggctaacctacccttcgaccggcgtactatcctccacgtgggtgccgaacgacggccccgtaggaacgtaaacgggcttaggaggttgggagtgggggatggaactaccaaaacctaaaccgaagtgggtacgacaaacaaaaaaacctntcggacaaagtaaagggtaaagtttaccgaaggggtacgaacgggtaccaaccgaacgtacgaaccgaacgggtaacacgtacataccagacaacgacgaccctaagacgtaggaanccgtagacgacgaggaactgaacatcgagaaccgtacgacgtacttaatttaagtcgttgttcgacgtaagggtactttcgggtttaccgggtggttaccgtttcggtttccgttttaagggg

SEQ ID NO: 348772 - DNA, 619 bp, Homo sapiens
  misc_feature: GZ8MTXP01B710S.45.37.D04.1.454.CMB.2.raw
  modified_base (257)..(257): a, c, t, g, unknown or other
  misc_feature (257)..(257): n is a, c, g, or t
  modified_base (458)..(458): a, c, t, g, unknown or other
  misc_feature (458)..(458): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaggtctccgtgcagtcttcgnggctacaccttcaccggcgactactcctccacgtgggtacgccgacgacggccccgtaggacgtaaggggtcttaggaggtggagtcgggatggactacccgaaaccctaagagtggacgaacaaacgaactgcgacacgtagtaacggtttacgacgggtcgtacggtacacgagtacgaaccggaaggaccacgtcacncgaacgacacacggtacctagagtggacgcgttagacgacgacgtacgtacgactacgtaacgacgaaccgaaccggaccgtaccttaagtttaccgtttcgttaggtcggtacggtaaggttcgttacgggtttaccggtcgtttcgttttaacccgggg

SEQ ID NO: 348773 - DNA, 679 bp, Homo sapiens
  misc_feature: GZ8MTXP01DEJ1S.45.37.D04.1.454.CMB.2.raw
  modified_base (640)..(640): a, c, t, g, unknown or other
  misc_feature (640)..(640): n is a, c, g, or t
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagccccactccccaggtgcagctggtgcagtcgtggggctgaggtgaggaagccgtggggcctcagtgaaggtctcctgcaggtcttgtggctacaccttcgaccggcgactatctccacgtgggtgcgacgacggccccctggacgaagggtcttggaggtggagtgggggatggactacaaaccctaacgaagtcgggtaggaccaaacgtaaaaaaccttagtgacaacgtaaaggtaacggtttacgaggggacgacggggtaccaaccgtagtacggaccgaacggggaacccaacggtacccaagtcaacggacaacgtacgaccctaacgaacgtcgggaacgtcgtagacgacgagtaacgtcgaactacgtcgtacggaaccgtaaccgaccgggttacccttaagttttaacgttaccgttgggttcgttacggggtaaggtacggtttcgggttttacccgggngggttccgtttttcgggttttaaccgtttttaaccgggg

SEQ ID NO: 348774 - DNA, 688 bp, Homo sapiens
  misc_feature: GZ8MTXP01C3QV9.45.37.D04.1.454.CMB.2.raw
  modified_base (226)..(226): a, c, t, g, unknown or other
  misc_feature (226)..(226): n is a, c, g, or t
  modified_base (257)..(257): a, c, t, g, unknown or other
  misc_feature (257)..(257): n is a, c, g, or t
  modified_base (278)..(278): a, c, t, g, unknown or other
  misc_feature (278)..(278): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccaacaagagcccactcccaggtgcagctggtgcgagtcgtggggctgaggtgaggagccgtgggctnagtgaaggtctctgcaaggcttctggctacnctcgacggcgactatcctccncgtggtcgacgacgacggcccctggaacgaaggggtcttggacggtggagtgggataggtactacctaaaacccccctaagaagtggtacggacctaaaaactaaactgtacgaccaaacgaagttaacggttcggacgggacgagggttaccaaccgagtacggaaccgaacggaacctaccggtacaacgtccgaagccctaaacgaccgtactaacgtaaggtagggaacgttcgaacgacgacgtaaacgtaccggtaacgtaacgtacgtaccggaacggaaccgaaccggtaaccggttaccgtttaagttttaacgttacggttcggttacggtaacgggttaggttaaccggttttacgggttaccgggtttcgggtttaaccggttttccgggttttaacg

SEQ ID NO: 348775 - DNA, 606 bp, Homo sapiens
  misc_feature: GZ8MTXP01AHY2A.45.37.D04.1.454.CMB.2.raw
  modified_base (226)..(226): a, c, t, g, unknown or other
  misc_feature (226)..(226): n is a, c, g, or t
  modified_base (255)..(255): a, c, t, g, unknown or other
  misc_feature (255)..(255): n is a, c, g, or t
  modified_base (494)..(494): a, c, t, g, unknown or other
  misc_feature (494)..(494): n is a, c, g, or t
  modified_base (500)..(500): a, c, t, g, unknown or other
  misc_feature (500)..(500): n is a, c, g, or t
  modified_base (512)..(512): a, c, t, g, unknown or other
  misc_feature (512)..(512): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagccccactccccaggtgcagctggtgcagtctggggctgaggtgaggagccgtggggcctnagtgaggtctctgcaggcttctggctacnccttcgaccggcgactactcctccgacgtggggtcgacgaccgacgggccccctggggaacaaggggcttggaggtggagtgggatgggactaccgaaaccctaagaagtggtacggaccaacgtaaaactgtcgacaacgtaagtaacgtttcgaggggacgaacgggtccaaccgagtacggaccgacgggacacgtaccatccgagacaaccgacgtacccgtaacgagtcgggancgtagngacagactgacntcgagaacgacgcggtacttagtttaacgtgttcggttgttccggtaaggtcgttcgggtttacggtggttccgtttggtttccgtttaacggg

SEQ ID NO: 348776 - DNA, 670 bp, Homo sapiens
  misc_feature: GZ8MTXP01C5EYT.45.37.D04.1.454.CMB.2.raw
  modified_base (275)..(275): a, c, t, g, unknown or other
  misc_feature (275)..(275): n is a, c, g, or t
  modified_base (291)..(291): a, c, t, g, unknown or other
  misc_feature (291)..(291): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctctgcaagcttctggctacacctcaccggcactatcnccacgtgggtgcgacncggcccctggacaagggcttggagtggagtgggatggactaccaaaccccctagaagtggtaggaccaaaaccgtaaactgtagaccaaacgtaaggtaagtttcggaaggggaccgtacggggtaccaacccgagtacggaacccgaaggggaaccaccgttaccaactcgaacgcctaacgaccgaccttaacgagttacgggacgtccgtaggaacgcaaacggtacgtacgaactacgttccgtaacggaaccggaaccgtaaccgggttacctttaaagtttacgttaaccgttgggttacccggtaagggtaaggttcgtttacggggtttaccgggttcgggtttccggtttcgggtttttttaaccccggg

SEQ ID NO: 348777 - DNA, 618 bp, Homo sapiens
  misc_feature: GZ8MTXP01A5Y4L.45.37.D04.1.454.CMB.2.raw
  modified_base (381)..(381): a, c, t, g, unknown or other
  misc_feature (381)..(381): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtgggcctgagtgaggtctctgcagctctggctacacctcaccggcgactatcgtccacgtgggtgcgacgacggcccctaggacgaacgggcttaggagtggagttggggatgggataccgaaaccccctaaacgaagtgggtacggacaaaactaaacgtntacgaccaagtacgtaaggttttcgaggggtacgacggggtacaaccgagtacgaccgacgggacacgtaccagtacgagcacgtacgacctacagtgacgcgtcgacgcgagacgtgacagttcgaacgaacgaccgccggttaccttaagttttacttaccgttgggttacgtccggaggttaaccgtttacgggtttacccgggttcggtccgttttcgggtttttaacccggg

SEQ ID NO: 348778 - DNA, 806 bp, Homo sapiens
  misc_feature: GZ8MTXP01BM8L0.45.37.D04.1.454.CMB.2.raw
  modified_base (253)..(253): a, c, t, g, unknown or other
  misc_feature (253)..(253): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtcgtggggctgaggtgaggagccgtggggcctcgagtgaaggtctcctgcgagcttcgnggctactacctcaccggcgactatctcccgacgtgggtgccggacacggcccccgtggaccgaagggtccttggaggtggagtgggggatacggacttaacccgaaaccccccgttaaacgaagttggggtacggacctaaaaacctaaaactaagttacggacctaaacgtaacgggttaaaagttttccgggaaacgggggacccgtaagggggttacccaaaccgtacgttaaccgggaacccggtaacggggaaccccgtaccgggttacccaacgttcccgaagaccccgaaacgacccggttaccctaacgtaacggttacggggaacgtccggttaacggaacggccgtaaaacggtaccgttaacggaaaccttacgtaacccggttaaggaaacccccggaccgtaaacccggggttccctttaaagtttttaacgttaccggttagggttccgggtaaccgggttaggggttaaccgtttttacgggtttaccccgggggttacgggttcccggttttttaaccggggttttttaaccccggg

SEQ ID NO: 348779 - DNA, 581 bp, Homo sapiens
  misc_feature: GZ8MTXP01ECK2K.45.37.D04.1.454.CMB.2.raw
  modified_base (419)..(419): a, c, t, g, unknown or other
  misc_feature (419)..(419): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctctgcaagcttctggctacacctcaccggcgactatctccacgtgggtgcgacacggcccctggacaagggcttggagtggagtggatggactaccgaaaccccctaacaagtggtggacaaacaaactgtgacacagtaagttcgagggcagggtacacgatacgacagggacacgtacanacagcacacgacctacagtggaagcgtagacgcgacgacgtgaacctatccgtaagaaccgacgaccggttcctaaagttttacttacgttggttacggtaaccggtaaggtaacgtttacgggtttaccgggttcgggttcgttttcgggtttttaacccg

SEQ ID NO: 348780 - DNA, 727 bp, Homo sapiens
  misc_feature: GZ8MTXP01DO5PX.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagtgtttagacagctaccaaacaataagaactacgtagcgttaggtaccaagacaacgaaaccgaggtcagccctacctaagctgctactagtttacgtgggcacgtaccgtacccgggtaacgtccccgggggtcccccctacggaaccgtacgttacgacggttcgggaccgtaacgggtccggggttccgtacgggggaaccctaagggtaccttttaccgtaacccttcccttaccgaacccgtaactccgaacgaccgaaccggcccgaaacgcgggaacggtacgtaagggaaacgtagtagggggttacggtacgtttaagttttaccgtggtacgttcggtactaagtaacttaaatttaacgtttaatttaacgttaaccctttccccgttacccggttcccgtttaccgggaccccggttagggttaaaacccgttaagggttagtaactaataaccgtaaacgtaccgttaggtccggttctaacg

SEQ ID NO: 348781 - DNA, 642 bp, Homo sapiens
  misc_feature: GZ8MTXP01DDRE9.45.37.D04.1.454.CMB.2.raw
  modified_base (258)..(258): a, c, t, g, unknown or other
  misc_feature (258)..(258): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagacgcccactccccaggtgcagctggtgcagtctggggctggaggtgaggacgccgtggggcctgagtgaggtctctgcagcttctgctacncctcgaccggcgactactctccacgtggtgcgacgacggcccctgggaacaagggtcttggacggttggagttgggatacgggactaccaaaacccccttagaaacgtgggtacgactaaaaccaaaactcgtacgaccgtaaacgtaacggtaaacgtttcggaacggggaccgtacggggttaccaacccgtaagtacggaaccgaaggggaactaccgtacacgacacgcaaacgcgaccttacagtaggaacgtgagacgcgaacgactgaacagtcgtaacgaacgttacgaccggttccttaaagtttacttacgttcggttacgaacggtaggtcgtttacggttccgggttgttaacgtttcggtttttaacccgg

SEQ ID NO: 348782 - DNA, 623 bp, Homo sapiens
  misc_feature: GZ8MTXP01EFMXC.45.37.D04.1.454.CMB.2.raw
  modified_base (248)..(248): a, c, t, g, unknown or other
  misc_feature (248)..(248): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagcgtgggcctcagtgaggtctctgcaggcttcngctacacctcacggcactatctccagtgggtcgcgacgacggcccctggacgaagggtctggaggtggagtgggataggaactaccgtaaaccccctaagtaagtggtacgaccaaaacgaaactgtcgacaacgtaaaggtaacggtttccggaagggtccgacgggtaccaaccgagtcgaaaccgacgggaaccacgtacacacgaacgcaacacgacctaacaggtggacgtcgagacgaccaaagcgtagactactcgaacgaaccgacgtacggttaccttaagtttaacgttacgttggttacgtaaccgggtaggttaacgtttccggggttacggttggttaaccgtttttcgggttttaacccgg

SEQ ID NO: 348783 - DNA, 610 bp, Homo sapiens
  misc_feature: GZ8MTXP01CGW2V.45.37.D04.1.454.CMB.2.raw
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (372)..(372): a, c, t, g, unknown or other
  misc_feature (372)..(372): n is a, c, g, or t
  modified_base (435)..(435): a, c, t, g, unknown or other
  misc_feature (435)..(435): n is a, c, g, or t
  modified_base (468)..(468): a, c, t, g, unknown or other
  misc_feature (468)..(468): n is a, c, g, or t
  modified_base (489)..(489): a, c, t, g, unknown or other
  misc_feature (489)..(489): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagcgtgggcctcgagtgagtctcngcagctcngctacncctcgaccgcgactactctccacgtggtcgcgacgaccggccccgtaggacgaaggtcttaggaggtggagtggatacggactacgaaaccccctaacgagtggtacgacaaaacaaacgtnacgacaacgtagtaagttcggagggtacacgggtacacgagtacggacgaggacctacgctancagaccacgacgtaccaagtaggtggacgtcgngacgccgagtactagactacncgtaacgaaccgttaccggtaaccgttactttaaagtttcgttaacgttggttacggtaacggtaggttaacggtttacgggtttacggttcggtttaaccgtttcggtttttaacccggg

SEQ ID NO: 348784 - DNA, 631 bp, Homo sapiens
  misc_feature: GZ8MTXP01BGZPF.45.37.D04.1.454.CMB.2.raw
  modified_base (256)..(256): a, c, t, g, unknown or other
  misc_feature (256)..(256): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggagatcctcttcttggtggcagcagccacaagagcccactcccaggtgcagctggtgcagtcgtggggctggaggtgaggaagccgtggggcctcgagtgaaggtctctgcgaggcttcgnggctacaccttcgaccggcgtactatcctccgacgtgggtcgccgacgacggcccccgtaggaacgaacgggtcttaggaggtggagtgggatggactacccaaaccctaagaagtcggtacggaaaccaacaacgtatcgacaaccgtaagtaacggtttacgagggacgtagggtaccaacgagtacgaaccgaacggggactacggaccagtacacgacaccgaacgggtccctaaagagtacgggaacgccgtagaacgcgaacgtacgtacgaactacgtcacggaaccgacgttaccggaccttaagttttacgttcgttggttcggacggtaagtcgtttacggttacgggtcggttcgttttccggg

SEQ ID NO: 348785 - DNA, 654 bp, Homo sapiens
  misc_feature: GZ8MTXP01EVUMN.45.37.D04.1.454.CMB.2.raw
  modified_base (257)..(257): a, c, t, g, unknown or other
  misc_feature (257)..(257): n is a, c, g, or t
tcagacgcgatcgacacgaccggtgctcgattttagtagcatactgttgggtttgggggcatcacccagcaaccacatctgtcctctagagaatccccctgagagctccgttcctcaccatggactggacctggaggatcctcttcttggtggcagcagccacaagagccccactccccaggtgcagctggtgcagtcgtggggctggaggtgaggaagccgtggggcctcagtgagtctctgcagcttctgctacnccttcgaccggcgactatcctccgactggggtcgccgaccgacgggccccgtaggacgaggcctttggaggtgggtagtggggatggaactacccaaaccctaaacgaacgttgggtaggaccaaactaaaaactatcgacaaacaggtaacggtttcgaacggggtcgaaacgggtacaaccgacgtacggaaccgaacgggaacgtaccggaccacgacacgacaacgacgaccgtacacgtggagccgagacgacgacgtacgtacgaactactcgttacggaacgaaccgaacccggtaccttaactttaaaccgtttttacgttacggttaggtaacggtacgggttaacggttcggtttaccgggtttcgggtttccggttcggttaaccg

SEQ ID NO: 348786 - DNA, 697 bp, Homo sapiens
  misc_feature: GZ8MTXP01DCVZR.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcaggtcgtggggctggaggtgaggaacgccgtggggcctcgagtgaaggtctctgcaaggcttctggctacacctcaccggcgactatctccacgtgggtgccgacgacggccccgtggaaccgaagggtccttaggaggttaggaggttgggagtagggataacccgaaaccccccttaaacgaagttgggtacggacaaaaacccaaaacgttgagaccaaacgtaaggtaacgtttacggacggggacgacggggtaccaaccgagtacgaaccggaacggggacctaacgtccgaacgtcgaacgcaacaccggaccttaacaggtacggacgtacgacggacgaccgaaagtacgttaggactaacttccgaacggaacgaaccggaaccggttaccttaaagttttacttaaaccggttggttacggaacggttaacgggtaacgttttacggggtttacccgggttgggtttcccgtttaacgggttttttccccgggg

SEQ ID NO: 348787 - DNA, 634 bp, Homo sapiens
  misc_feature: GZ8MTXP01AJL2V.45.37.D04.1.454.CMB.2.raw
  modified_base (225)..(225): a, c, t, g, unknown or other
  misc_feature (225)..(225): n is a, c, g, or t
  modified_base (505)..(505): a, c, t, g, unknown or other
  misc_feature (505)..(505): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagcgtgggcctnagtgaaggtctcctgcaggtcttctcggctacacctcaccggcgactactcctccacgtgggtgcgacgacggtccccgtaggacgtaaggcttgaggtggagtggagtggactaccgaaaccccctaagaagtgggtacggacaaaacgaaacttgcgactaaccgaaggtaacgtttcgaacggggtcgtaacgggtaccgaacgacgtacggaaccgaaggggtaccaacgtaccacgtacgagacctaacgacgacctaacgagtacggactccgngacgacgaaggacgtcgaacctacgtcgaacgaaccgttacgaccgttccttaaagtttacttacgttgcgaacggtaggtaacgtttcgggttaccgggttcggtttaacgtttcggtttttaacccg

SEQ ID NO: 348788 - DNA, 783 bp, Homo sapiens
  misc_feature: GZ8MTXP01AOYDN.45.37.D04.1.454.CMB.2.raw
  modified_base (544)..(544): a, c, t, g, unknown or other
  misc_feature (544)..(544): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagacgcccactcccaggtgcagctggtgcgagtcgtgggctgaggtgaggagccgtgggcctcgagtgaggtctccgtgacaggtcttcgtcggctacgaccttcgaccggcactactcctccacgtgggtcgccgaccgccgggacccctagggaactaagggggtcttacgggaggttggaggtgggatcggaactacctaaacccgtaacgaaggtgggtacggaacctaactaaaacgtactcgacctaaacggtaaaggttaacggtttaccggaacggggtaccgggtaaacggggttacccaaaccggtaacgtaccggggaaacccggtaacggggtaaacccggtaaccttacccgtaagtaacccgggaacncccgtaaaaccgccgggtaaaccctaacggggtaaaccgtaggggtaacgtacgtacgggaacgacgaaccggtaacgttaccggaaacttacgtaccgtaacgggaaaccgtaaccggttaaccggttacctttaaagtttaaacgttacggttcgttacggttaccgggttaaggtaccggttttcgggttaacgggtcggttttccggtttaacggttttcccggttttaacgggg

SEQ ID NO: 348789 - DNA, 648 bp, Homo sapiens
  misc_feature: GZ8MTXP01EEWKQ.45.37.D04.1.454.CMB.2.raw
  modified_base (296)..(296): a, c, t, g, unknown or other
  misc_feature (296)..(296): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagccccactcccaggtgcagctggtgcagtcgtggggctgaggtgaggaagccgtggggcctcagtgaggtctcctgcaggcttctggctacaccttcgaccggcgactactctccacgtggggtgccgacncgggccccctagggacgaagggcttggaggtggagtgggatggataccaaacctaacagtggtacggacaacaaaactatgacaacgaagtagtttcgaggggctagggtacacgagtacgacgtagggaacaccggtacataccgagaccaacgacgtacccgtaacgtaggtcgggaacgtcgtacggacgaccgaacgtaccgttagaacctattccgacggaaccgtaaccgaccggtaccctttaaattttaaacgttccgttaggttcggttaccgggtaaggtttaacgttcgggtttaacccgggtggttccggttttcggtttttaacccgttttaaccgggg

SEQ ID NO: 348790 - DNA, 721 bp, Homo sapiens
  misc_feature: GZ8MTXP01CGDYP.45.37.D04.1.454.CMB.2.raw
  modified_base (254)..(254): a, c, t, g, unknown or other
  misc_feature (254)..(254): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaacgccgtggggcctcgagtgaaggtctctgcagcttcnggctacacctcgaccggcgactatctccacgtggtcgcgacgcggcccctaggaccgagggcttggacggttggagtgggaatcgggaactacccaaacccccgtacaaggtcggtacgacctaaaacaaacgttgacgacctaaacgtaaggtaacggttaccgaggggtacccgacgggtaccaacgaacgtcgggaaccgaacggggtaacctaaccgggttaccaacgacgaacgaccaacgaacggtacccctaagtaggttacggacgacgtacgacggacctaaggaccttacgaacgtcgttcccgtaacggaacccgaaccgtaacccggttaccctttaaagtttttccggttaaaccgttggggttaccggtaaccgggttaagggtaaccggttttaacggggttttaccccggggttaggttcccggttttttaacggggttttttaaccccgg

SEQ ID NO: 348791 - DNA, 579 bp, Homo sapiens
  misc_feature: GZ8MTXP01ERZKP.45.37.D04.1.454.CMB.2.raw
  modified_base (360)..(360): a, c, t, g, unknown or other
  misc_feature (360)..(360): n is a, c, g, or t
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
  modified_base (471)..(471): a, c, t, g, unknown or other
  misc_feature (471)..(471): n is a, c, g, or t
  modified_base (506)..(506): a, c, t, g, unknown or other
  misc_feature (506)..(506): n is a, c, g, or t
  modified_base (547)..(547): a, c, t, g, unknown or other
  misc_feature (547)..(547): n is a, c, g, or t
tcagacgcgatcgacacgaccggtgctcgatttagtagcatactgttggggtttgggggcatcacccagcaaccacatctgtcctctagagaatcccctgagagctccgttcctcaccatggactggacctggaggatcctcttcttggtggcagcagccacaagagccccactccccaggtgcagctggtgcagtcgtgggggctggaggtgaggagccgtgggggcctcagtgaaggtctcctgcaaggcttctggctacaccttcaccggcgactatctccacgtggggtgccgacacgggccccctgggaacaggggcttggagtgggatggggatggatacaaccctaagatggngcaacaaaactntgcaanagtaagttgagggtcagggtcaccatcgaccgagggacacgccatcagcaactagccctagngtggacncgtagacgcaagctagaccatcgnggaaccgacaccgggaccttaagttttaacgttcngggttcgcgggtaaagggtgtttaacgggttttaccggggnggttccgtttcgggttttccttttaacggggg

SEQ ID NO: 348792 - DNA, 590 bp, Homo sapiens
  misc_feature: GZ8MTXP01AS1VQ.45.37.D04.1.454.CMB.2.raw
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
  modified_base (379)..(379): a, c, t, g, unknown or other
  misc_feature (379)..(379): n is a, c, g, or t
  modified_base (418)..(418): a, c, t, g, unknown or other
  misc_feature (418)..(418): n is a, c, g, or t
  modified_base (445)..(445): a, c, t, g, unknown or other
  misc_feature (445)..(445): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctgagtgaaggtctcctgcaagcttctggctacacctcacctgcgatactctccacttgggtnccgacaccggccccnggtaacgaagggtcttgagtggagtgggatggactaccccaaaccctaaacgaagtcggaggaccaaactaactntaggcaacgagtaagtttcgagggacagggtaccacganaggacccaaggggtaccaacgtccaancgagacacgacggactaacgagtagacgcgagacgacgacgtacgacgtacacgtcgtacgacgaacgaccgtaccgttaacttacgttacgttacgtcgtacggtaacggtacggttacggttacggttcgggttcggtttcgg

SEQ ID NO: 348793 - DNA, 708 bp, Homo sapiens
  misc_feature: GZ8MTXP01AS5MX.45.37.D04.1.454.CMB.2.raw
  modified_base (261)..(261): a, c, t, g, unknown or other
  misc_feature (261)..(261): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtggggcctcgagtagacggtctctgcaggtctcgtggctacncctcgaccggcgactatcctaccgacgtgggtcgaccgaccgtaccgggcccccgtagggaccgtaaggggtccgttaggagggtacgggaaggtggggagttagggactacctaaaacccccgtaacgaagtgggtacggaccaaaacgtaaactgtagaccaacgtagtaacgtttcggagggtccgaggtaccaacgacgtacggaccgagggacccacgtaccatccgagccaacgacgacctaacgaggtcggacgtcgtacggaagcccgaaagtaccgtacgaccgtaacgttccgggaacgaaacccggaacccggtacccgggttacgttttaaacgtttaacgttaccggttggttaccggggtaacggtaaaggttgggttttaccccggggtttaccggggttgttttccgggtttcgggttttttaaccccggg

SEQ ID NO: 348794 - DNA, 635 bp, Homo sapiens
  misc_feature: GZ8MTXP01DX6S2.45.37.D04.1.454.CMB.2.raw
  modified_base (227)..(227): a, c, t, g, unknown or other
  misc_feature (227)..(227): n is a, c, g, or t
  modified_base (239)..(239): a, c, t, g, unknown or other
  misc_feature (239)..(239): n is a, c, g, or t
  modified_base (248)..(248): a, c, t, g, unknown or other
  misc_feature (248)..(248): n is a, c, g, or t
  modified_base (270)..(270): a, c, t, g, unknown or other
  misc_feature (270)..(270): n is a, c, g, or t
  modified_base (282)..(282): a, c, t, g, unknown or other
  misc_feature (282)..(282): n is a, c, g, or t
  modified_base (372)..(372): a, c, t, g, unknown or other
  misc_feature (372)..(372): n is a, c, g, or t
  modified_base (491)..(491): a, c, t, g, unknown or other
  misc_feature (491)..(491): n is a, c, g, or t
  modified_base (515)..(515): a, c, t, g, unknown or other
  misc_feature (515)..(515): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcgcactcccaggtgcagctggtgcagtcgtggggctggaggtgaggaagcgtgggcctnagtgaggtctcngcagcttgngctacacctcgaccgcgactanctccagtggtcncgacacggcccctaggacgaagggcttaggagtgggagtgggatggactaccccgaaaccctaaagagtggtacgaaccaacgtaacgtntacgactaaacgtaaggtaacgtttcggacgggtacgacggggtaccaacccgagtacggaacccgtaaaggggaccacggtaccagtacgagacacgacgtactaacgacgtaggacngtacgagtaccgaagcgtacgacngttaacgacgacggtaaccgttccggtaaacttaactttaagttccgagggtttaaccggaccgggtaaaggtttcggttaccgggtttaccgggttccggtttcggtttttaacccggg

SEQ ID NO: 348795 - DNA, 660 bp, Homo sapiens
  misc_feature: GZ8MTXP01BC4ZA.45.37.D04.1.454.CMB.2.raw
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (521)..(521): a, c, t, g, unknown or other
  misc_feature (521)..(521): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtgggcctgagtgaggtctctgcagtctcgngctacncctcgaccggctactactcctccgaggtgggtcgacgacgaccggccccgtaggacgtaaggggtcttaggaggtggagtggggattacggaactaccgaaaaccccctaagtaacggtgggtacgacctaaaactaaaacctgtacgaaccaacggtaagtaaacggtttacgggaggggtaccgaagggttacccaaaccgtagtaccggaaccggacgggtaaccctacggtaccacgtacagaccacgaccgtccgtaacgngtacggagtcgtaggacgacgaacgactacgactatccgaacgaccgttacgaccggttcttaaagtttcgttacgttggaggtaacggtggtaacgtttcgggttacggttcgggttcgttttcgggttttaacccgg

SEQ ID NO: 348796 - DNA, 623 bp, Homo sapiens
  misc_feature: GZ8MTXP01B1MX1.45.37.D04.1.454.CMB.2.raw
  modified_base (227)..(227): a, c, t, g, unknown or other
  misc_feature (227)..(227): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtgggcctnagtgaggtctcctgcaaggcttcgtggctacacctcgaccggcgtactatcctcacgtggtcgacgacgacggccccgtaggacgaagggtcttaggagtggagtgggatggactaccaaacccccgtaacatggtaggactaaacaaactgtgacacgagtaagtttcgagggcaggtccacgtagcgaccgaggaccacgtaccagtcagacaacgacgaccgttaacaggtcgaacgccgtagacggacgaacgacgttcgaactactcgtaacaacccggacgtaaaccgggacctttaatttaacgttaccgttgggttacggtaacggtaggttaacggtttcgggtttaccggggttcgggttaaccgttttgggttttttaaccccgg

SEQ ID NO: 348797 - DNA, 678 bp, Homo sapiens
  misc_feature: GZ8MTXP01C45QL.45.37.D04.1.454.CMB.2.raw
  modified_base (227)..(227): a, c, t, g, unknown or other
  misc_feature (227)..(227): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtgggcctnagtgaggtctctgcagctctgctacacctcaccggcgtactatcctccacgtgggtcgaccgacgacggccccgtaggacgaagggtcgttggaggttggagttgggatggactaccaaaccccctaacaagtgggtacgaaccaaaactaaactgtacgaccgaaacgtaaggtaacggtttacggacggggtacgtaacggggtaccaaaccgtagtacggaaacccggaaacggggaaccctaacccggttaccaacgtaccgaacgaccaaccgtaccgtacccttaacgaaggtacggacgccgagacgacgaaggtacctagaactactcgaacggaaccgaccgtaccggttacctttaaatttacgttaacgttggttaggaaccggtaaggttcgtttacgggttaccgggttcgggtttcgtttcgggttttttaacccgg

SEQ ID NO: 348798 - DNA, 556 bp, Homo sapiens
  misc_feature: GZ8MTXP01AZFIU.45.37.D04.1.454.CMB.2.raw
  modified_base (365)..(365): a, c, t, g, unknown or other
  misc_feature (365)..(365): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacacctcaccggcgactatctccactgggtgcgacacggcccctggacaagggcttgagtggagtgggatggactcaaaccccctaacaagtggtggacaaacaaactntgacaacagtaagttcgagggcgagggtcacatcgaccgagggacacgtcatcagcacacgcctaacagtcggagcgtggaacgcgacgactgaactacttcgcgaacgacgaccggcctaattttacttacgttgttacgtcggtaggtaagtttcggtttaccgggttggttcgtttcgggtttttccg

SEQ ID NO: 348799 - DNA, 602 bp, Homo sapiens
  misc_feature: GZ8MTXP01C6A53.45.37.D04.1.454.CMB.2.raw
  modified_base (307)..(307): a, c, t, g, unknown or other
  misc_feature (307)..(307): n is a, c, g, or t
  modified_base (366)..(366): a, c, t, g, unknown or other
  misc_feature (366)..(366): n is a, c, g, or t
  modified_base (388)..(388): a, c, t, g, unknown or other
  misc_feature (388)..(388): n is a, c, g, or t
tcagacgcgatcgacacgaccggtgctcgatttagtagcatactgttgggtttgggggagcatcacccagcaaccacatctgtcctctagagaatcccctgagagcctccgttcctcaccatggactggacctggaggatcctcttcttggtggcagcagccacaagacgcccactcccaggtgcagctggtgcagtcgtggggctggaggtgaggagccgtggggcctcagtgaaggtctccgtgcgaaggcttctcggctacctacctccgaccggcgactactcctccacgtgggtcgccgacncggccccgtaggacgtagggcttaggagtggagtgggatggactaccaaaccccctaanaagtggtagaccaaacaaactntcgaccagaagtagttcgagggacacgggtcacgtagacgaccgaagggacaccgtcacgtcacgcaacgacgacctacgagtacgggagctagacgaccgaagactcgaactacttcgaacgaaccgaccgtaccggttacttaagtttacttacgttggttacgcggtagtcgtttcgggtttacggttcggttaacgtttcggtttttccg

SEQ ID NO: 348800 - DNA, 594 bp, Homo sapiens
  misc_feature: GZ8MTXP01DI4QB.45.37.D04.1.454.CMB.2.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (439)..(439): a, c, t, g, unknown or other
  misc_feature (439)..(439): n is a, c, g, or t
  modified_base (455)..(455): a, c, t, g, unknown or other
  misc_feature (455)..(455): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctggaggtgaggaagccgtgggcctnagtgaaggtctcctgcaaggcttcnggctacacctcaccggcgactatctccacgtgggtgacgacgacggcccctggaacaagggtctggagtggagtgggatcggactaccaaacccctaacaagtggtacgacaaaccaaactgtgacaacgagtaacgtttcgaggggtacagggtcaaccgagtacgacgaagggacacgtcactnacgtcacacgctaacngtaggacgtcgagagcaacgtactgactactcgaagaaccgacgtaccggttaccttaagtttacttaacgttgttacggaacggtaaggtaacgtttcgggtttacggggttcgtttcgtttcgggtttttaacccgg

SEQ ID NO: 348801 - DNA, 663 bp, Homo sapiens
  misc_feature: GZ8MTXP01DWOVD.45.37.D04.1.454.CMB.2.raw
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtgggcctgagtgaggtctcctgcaggtcttgtgctacaccttcaccggcactatcctccacgtgggtcgcgacaccggccccgtaggacgaagggtcttggaggtggagtgggatggactacccaaccctaagaagtggtacggaaccaaacaactagtacgacctaacgaaggttaacggtttcggacggggacgtacgggtaccaaccgagtacggaacccggaacgggtaccaccggttaccagaccaagaccgtaaccgacggggtaccccttaagaagtcgggacgtaccgtaggaacgaccgaagtaaccgtacgaactcgtaacgtacgaaccgtaaccgttaccgggtaccttaagttttaacgttcgttgggtaacggtacgggtaaggttacgtttcgggtttaccgggtcgggtttaaccgttttccggg

SEQ ID NO: 348802 - DNA, 673 bp, Homo sapiens
  misc_feature: GZ8MTXP01CY6LL.45.37.D04.1.454.CMB.2.raw
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtggaggaagcgtggggcctcgagtgaaggtctcctgcaaggcttcnggctacncctcaccggcgactatctccacgtgggtcgcgacacggcccctaggacgaaggcttggaaggtggagtggataggataccgaaacccctaacgaatgggtacgacaaacaaactgtgacaacgagtaacgttcgagggacgtacgggtacaccgaagttcggaacccgaggggaactaccggtaccagtacgacgacaaacgacgccttaacgaggtacggaacgccgtagaacgacggaataaccgtgaaccgtacgtacgtaacgaaaccccggacgtaaacccgggttaccctttaaagttttacttaccggttgggttacggtaaccgggtaaaggtttcggttttacccggggttttaccccggggttgggttaacccggttttttcggggttttttaaccccggg

SEQ ID NO: 348803 - DNA, 739 bp, Homo sapiens
  misc_feature: GZ8MTXP01BDTH3.45.37.D04.1.454.CMB.2.raw
  modified_base (248)..(248): a, c, t, g, unknown or other
  misc_feature (248)..(248): n is a, c, g, or t
  modified_base (595)..(595): a, c, t, g, unknown or other
  misc_feature (595)..(595): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggagatcctcttcttggtggcagcagccacaagagcccactcccaggtgcagctggtgcagtctggggctgaggtgaggaagcctggggcctgagtgaaggtctcctgcagcttcnggctacacctcaccggcgactatctccacgtgggtgccgacgacggccccgtaggaccaagggtcttggagtggagtgggatggataccgaaaccccccttaagaagtcgggtaggaccctaaaacgaaacccttaagtacgacctaaccgaaaggttaacggtttacgaaacgggggtaccgagggggttacccaaccgtaacgtaccggaacccggaagggggtaaaccccaaccgggttacccaacgtaccgaacggtaccaacccgtaacggtaccccttaaagaccgggttagggaaccggtccgtagggaacccgagttaaacgggaccttacggaaaccncgttccgaacggtaacccgacccggtaaacgggttccccgtttaaattttacgttaacccgttggttacgggtaacggtaacggttaacggtttcgggtttaacccgggttcggggttaaccgttttcggggttttttccccgg

SEQ ID NO: 348804 - DNA, 547 bp, Homo sapiens
  misc_feature: GZ8MTXP01DU8OH.45.37.D04.1.454.CMB.2.raw
  modified_base (362)..(362): a, c, t, g, unknown or other
  misc_feature (362)..(362): n is a, c, g, or t
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
  modified_base (507)..(507): a, c, t, g, unknown or other
  misc_feature (507)..(507): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcgagtctggggctggaggtgaggagccgtgggcctcgagtgaagtctcctgcaagcttctggctacacctcaccggcgactatctccacgtggtgcgacaggccccctggacaagggcttgagtggatgggatggactacaacccctaacaatggtagacaaacaaactntgacaacgagaagtttcgaggggcaggggtcaccgtagacgaccgagggaacaccgtccatacagcacgacgacctacagtagganctagngcaagacctgacatcgtaagacgacacgttcctaatttacttacgttgttacgngtaaggtgttaggttcccggttggtcgtttgtttttccgg

SEQ ID NO: 348805 - DNA, 712 bp, Homo sapiens
  misc_feature: GZ8MTXP01ALT1Z.45.37.D04.1.454.CMB.2.raw
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccaacaagacgcccactcccgaggtgcagctggtgcgagtcgtggggctggaggtgaggagcgtgggcctgagtgaggtctcgtgacgaggtcttcgtggctacaccttcgaccggcgactatcctaccacgtgggtcgccgacgaccggtcccccgtaggacgaaggggtctttaggaggttagggaaggttcgggggaattacgggtaactaacccgtaaaacccccgtaaacgtaacggttgggtacggaccaaacggtaaaaaaccttacgtaacgaacctaaacgtagggttaaacggtttcggaacgggggacgtaacgggttacccaaacgtacgtacggaaccggacgggaaccgtaccggtacaactcaacggacaacaccgactaccgagtacggacgtccgtagacgacgaacgtacgtacggaactactacggtcggaaccgtaacgaccgggtaccttaagtttacgtaccgttggttcggttagtaacgggttacgttcggtttacgggtcgttcgtttcggttttaaccgtttaacgggg

SEQ ID NO: 348806 - DNA, 710 bp, Homo sapiens
  misc_feature: GZ8MTXP01AODKH.45.37.D04.1.454.CMB.2.raw
  modified_base (162)..(162): a, c, t, g, unknown or other
  misc_feature (162)..(162): n is a, c, g, or t
  modified_base (191)..(191): a, c, t, g, unknown or other
  misc_feature (191)..(191): n is a, c, g, or t
  modified_base (298)..(298): a, c, t, g, unknown or other
  misc_feature (298)..(298): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttctggtggcagcagccanaagagccccactcccaggtgcagctggtncagtcgtggggctgaggtgaggagccgtgggcctgagtgaaggtctccgtgactaaggtcttctggtctaccacctccgaccgggctactactcctccacgtgggtnccgacacggcccctaggacgaagggtctaggagtggagtgggattaggactccgtaaaacccccccgtaagtaaggttcgggacggacaaaaaacccgtaaacgttcgaccggactaaacggtaacgggttaaacggtttacggaacggggtcccgaacggggtaccaaaccgtacgttacggaacccggtaacgggaacccgtacggtaccaacggtaccacggacaaccgttttaccggacccgttaactaggtacggaacgtcgacgacggtacaacggtactcggaaacctacgtacgaacgtaaccgaccggtaccgttacgttaacgtttaacgttcgttacggttacggtaacggttacggttaacggtttcgggtttaccggttggttccgtttcggtttccgg

SEQ ID NO: 348807 - DNA, 821 bp, Homo sapiens
  misc_feature: GZ8MTXP01BDHQ2.45.37.D04.1.454.CMB.2.raw
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtggggcctcgagtgaaggtctccgtgcgaaggtcttcgtggctacaccttcaccggcgacttatcctccgacgtgggtcgcgacgacggcccccgtgggaccgaacggggtctttaggaggtacggggtaagttagggggtagttacgggtaactaaccctaaaaccccgtaaaccgtaaaggttcggggttacgggaacccaaactaaaaaaaaacccgttagttaacggaccctaaaaccgtaaagggttaaacggttttaccggaacggggggtaccgtaaacgggggttacccaaccgtaacggttaccgggaaaccggtaaacggggaacccgtaaaccccggttaccgaacgttaccgaaacggtcctaaaccgaacgtacccccgttaaagggaaccggttaggggaccggtaccgttagggaaccgaccgaaagtacccgtaacggtaaacctacggttacgtaaccggtaaccggaaccgttaaccgggttacccgttaaattttaacgttacgttacggttcggttacgggtaaggttaacgtttcgggtttacccggggtgttacccgtttgggttttaacccgttttaacggg

SEQ ID NO: 348808 - DNA, 690 bp, Homo sapiens
  misc_feature: GZ8MTXP01EFXV3.45.37.D04.1.454.CMB.2.raw
  modified_base (348)..(348): a, c, t, g, unknown or other
  misc_feature (348)..(348): n is a, c, g, or t
  modified_base (410)..(410): a, c, t, g, unknown or other
  misc_feature (410)..(410): n is a, c, g, or t
  modified_base (465)..(465): a, c, t, g, unknown or other
  misc_feature (465)..(465): n is a, c, g, or t
  modified_base (491)..(491): a, c, t, g, unknown or other
  misc_feature (491)..(491): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgacccagtctccagacctcctggctgtgtctcgtgggcgaggacggcccacatcaacgtgacacgtccagccagtagttgttagacacgcctaacaaacaataaacgtaacttactagtcgtacgtaacagacaaacgaaaccgacgtacacgtccctacctaagctacgtactacttacgtttacgnggtacctacgttacccgtaacccgggtacggtccccggggtccccacggtaccgtagtacgnggtacggacgtcggggtcgggtcgtagggactagtactttacaccttctacaccnctacgacgcgacgctaggcgtacggngtaaggaacgttggtaggggtacgttacgttagtttagtacgtcggttataccgtaagttaataaacgttttaatttaacttacttaacccgttccgttaacccggttaaccggtttcccggacccggttaacgggaaccgttaagggttaccgtaagtaaacgtaactaaaaccggtgttacgtaacgttcgtaaccg

SEQ ID NO: 348809 - DNA, 705 bp, Homo sapiens
  misc_feature: GZ8MTXP01A74GC.45.37.D04.1.454.CMB.2.raw
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagacgccccactcccaggtgcagctggtgcagtcgtggggctggaggtgaggacgccgtggggcctgagtgagtctcctgacaggtcttcgtggcctaccaccttcgaccggcgtactactcctccgagtgggtcgccgtaccgacggtcccccgtagggaaccgtaacgggggtcgttaggaggtagggtacggttgggggagttacgggaactaacccgaaacccgttaaaccgtaaggttcggggtacggaacctaaacctaaaaaaaccgttagtcgaaccgtaaacggtaaagggttaaacggtttcgggacgggggtacgtaacggggtaccaaccgtagtaccggaaccgaacggggaccctaacgtaccaagcgacgaccaacgacgacccgtaaggtagtcggacgtcgagaacgcgtaagaccgtgactacgtacgacgaaccgacgaacggttcttaagtttacgtcgttgttcgacggttaagtggttcggttacgggtcgtttcggtttcgttttaacgtttaacggg

SEQ ID NO: 348810 - DNA, 768 bp, Homo sapiens
  misc_feature: GZ8MTXP01DO3V1.45.37.D04.1.454.CMB.2.raw
  modified_base (384)..(384): a, c, t, g, unknown or other
  misc_feature (384)..(384): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaagccgtggggcctcgaggtgaacgtctcctgacgaggcttcgtggcctacaccttccgaccggcgactactcctccgacgtgggtcgacgacgacggcccccgtagggaacgtaagggtcgttaggaggtggagttgggatagggacttacccccaaacccgtaanaagtgggtacggaaaccaaactaacgtagtacgacgtaaacgtaaggttaaaggtttcgaacggggtacgtaaggggtacccaaaccgtagtaccggaaaccggaacggggacctaaccggttaccaaacgtccaaacgggaccaaaccggacggggtaaccccttaacgaaagggttcgggaaacggtcccgtaagggaaccgaaacccgtaaggaaccgttaccggtaaacgaaaccttccggaaacgggttaacccgaaacccgggttacccggttacccttaaatttttaaccgttaacggttggttaaccgggtaaggtaacggggtttaaacgttcggggttttaccccggggtggtttccgggtttttaacccgggg

SEQ ID NO: 348811 - DNA, 705 bp, Homo sapiens
  misc_feature: GZ8MTXP01C8EP8.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagcgtgggcctgagtgaaggtctctgcaaggctctgctacacctcacggcgactatctccacgtggtgcgacacggccccgtggacgaagggcttgagtggagtcgggataggataccgaaaaccccctaacaagtgggtacggaccaaaacaaaacttaagacgaccgaaacgtaaggtaacgtttaccgaaggggtaccgaacggggtacaacccgtaagtaacggaaccgaaacggggaactaccggtacaacgtacgaacgaccgaaccaccggtaccgttaaaccgtaacggtagggaacgtcccggtaaggaacgggtacccaaaggttaccgtaacgaacgtaaccgtaaccgtaaccggtaaccgaaaccggtaaccggttaaccgttaacgttttaacgtttaacgttcggttacggtaacgggtaacggttaacggtttacgggtttaccgggttacgggtttccggtttccggttttccgg

SEQ ID NO: 348812 - DNA, 601 bp, Homo sapiens
  misc_feature: GZ8MTXP01EIBXH.45.37.D04.1.454.CMB.2.raw
  modified_base (197)..(197): a, c, t, g, unknown or other
  misc_feature (197)..(197): n is a, c, g, or t
  modified_base (257)..(257): a, c, t, g, unknown or other
  misc_feature (257)..(257): n is a, c, g, or t
  modified_base (290)..(290): a, c, t, g, unknown or other
  misc_feature (290)..(290): n is a, c, g, or t
  modified_base (296)..(296): a, c, t, g, unknown or other
  misc_feature (296)..(296): n is a, c, g, or t
  modified_base (369)..(369): a, c, t, g, unknown or other
  misc_feature (369)..(369): n is a, c, g, or t
  modified_base (428)..(428): a, c, t, g, unknown or other
  misc_feature (428)..(428): n is a, c, g, or t
  modified_base (454)..(454): a, c, t, g, unknown or other
  misc_feature (454)..(454): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagacgcccactcccaggtgcagctggtgcagtcgngggctggaggtgaggagccgtggggcctgagtgaggtctcctgcaagtctcgtggctacnccttcgaccgcgactatcctcgacgtgggtacncggacncggcccaggacgaaggctaggagtgggagtgggatggactaccaaacctaacgagtggagaccaacaaaactntcggacaacgagtagttacgagggcgacggtacacctagacgacgacggacacgactancagcacgacgactacgagtacggacncgtacgagacgagtaacgcgtaacacttcgaacggaaccgtaaacgccggtaccttaagtttaacgtcgttaggttcggttacgtaacgggttagtttccggtttacggggtgttccggttttcgggtttttccgtttaaccggggg

SEQ ID NO: 348813 - DNA, 638 bp, Homo sapiens
  misc_feature: GZ8MTXP01EZPHZ.45.37.D04.1.454.CMB.2.raw
  modified_base (256)..(256): a, c, t, g, unknown or other
  misc_feature (256)..(256): n is a, c, g, or t
  modified_base (351)..(351): a, c, t, g, unknown or other
  misc_feature (351)..(351): n is a, c, g, or t
  modified_base (486)..(486): a, c, t, g, unknown or other
  misc_feature (486)..(486): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggacgccgtgggcctgagtgaggtctctgcgagctctggctacncctcaccggcactatctccgacgtgggtcgcgacgacggccccgtggacgaagggtctaggagtgggagtgggatggaactccaaaccccctaanagtcggtagaccaaaacaaactgtcgacaacgtaagtaaggtttcgaggggacgtacgggtaccacgagtacggaaccgagggaacccacgtaccaactacgacgaccaacgacggaccctaacgagtacggganccggtagacgcgaagacgtacgaacacgtcgtaacggaaccgttacgaccggttaccttaattttaacttacggttgttacgggtaaccgtagggttaacggtttcgggtttccggggttcgttaacggtttttccgggtttttaacccggg

SEQ ID NO: 348814 - DNA, 579 bp, Homo sapiens
  misc_feature: GZ8MTXP01BCTMY.45.37.D04.1.454.CMB.2.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
  modified_base (359)..(359): a, c, t, g, unknown or other
  misc_feature (359)..(359): n is a, c, g, or t
  modified_base (443)..(443): a, c, t, g, unknown or other
  misc_feature (443)..(443): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtgggcctnagtgagtctctgcagctcngctacnctcaccgnactatcnccagtgggtcgcgacgacggcccctaggacaagggtcttggagtggagtggatggactaccaaaccccctaacagtggtgacaaacaaactntcgcaacgagtaagttcgagggtacacgggtcaccgatcggaaccgagggaccacgtcagtacgacgcactacgacctacgagngacgcacggagaccgaagacctagactacgtccaacggaccgacgaaccggttccttaaagttttacttacggttggttacgtcggaaggttccgttagggtttcccgggttgtcccgtttgggtttttaacccgg

SEQ ID NO: 348815 - DNA, 860 bp, Homo sapiens
  misc_feature: GZ8MTXP01A1KGT.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttctggtggcagcagccacaagagcccactcccaggtgcagctggtgcagtcgtggggctggaggtggaggagccgtggggcctcgagtgaaggtctccgtgactaaggcttcgtggtctactacccgtcgacccggcgaacttacgtcctaccctaacggtcggggttcgacccggtaacgaccgggtaccccccgtagggaaaccggaaacgggggttccgtttagggtaagggtagggggtaacggttagggggtaacgttacgggggaaccttaaccccgtaaaaacccccccccgttaaaagttaaaaggttcggggttaacgggaaccctaaaaaccgtaaaaaacccgtttaagtacggtaaccgaaaacccggtaaaggtttaaacggttttaccgggaaacgggggtaaccggtaaccggggttaacccaaacccggtaacggttaccgggaaaacccgaacggggggtaaacccctaaccgggtttacccaaacgttcccgaaacgggacccaaaccggaaccgtacccggtttaaaccgaagggtttacgggaaccgtccgtaggaacggaccgaagtaccgtacgacacgttacgaacgaccggaaacgtacccggacttaacgttacgttaacgttggttccgaagggtagttaacggtttacggtttacccgggttggttcggttttaacgggtttttcccgg

SEQ ID NO: 348816 - DNA, 572 bp, Homo sapiens
  misc_feature: GZ8MTXP01DQA12.45.37.D04.1.454.CMB.2.raw
  modified_base (223)..(223): a, c, t, g, unknown or other
  misc_feature (223)..(223): n is a, c, g, or t
  modified_base (234)..(234): a, c, t, g, unknown or other
  misc_feature (234)..(234): n is a, c, g, or t
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
  modified_base (404)..(404): a, c, t, g, unknown or other
  misc_feature (404)..(404): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctgtaggatcctcttcttggtggcagcagccacaagacgcccactcccaggtgcagctggtgcagtcgtgggctgaggtgaggagcgtgggcctnagtgagtctcngacagtctcgtggctacaccttcgaccggcactatcctcacgtgggtcgacgacgcggccctaggacgacggtctggaggtggagtgggataggactacaaacctaanagtggngacaactaaaactntgacaagtaagtaacgttcggagggtacacgggtacacgtancggaacgaggacacgtacatcagcaagacacctaagaggtcggactcgagaccgcgagacagtactactacgacgtaacgacgttacggtacttagtttaactcgttagttcggttacgtgggttacttaacgggtttcggtcgttcgtttcggttttcgttaacggg

SEQ ID NO: 348817 - DNA, 725 bp, Homo sapiens
  misc_feature: GZ8MTXP01CA14K.45.37.D04.1.454.CMB.2.raw
  modified_base (256)..(256): a, c, t, g, unknown or other
  misc_feature (256)..(256): n is a, c, g, or t
  modified_base (402)..(402): a, c, t, g, unknown or other
  misc_feature (402)..(402): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcaggtcgtggggctggagggtgaggaagccgtggggcctgagtgaaggtctctgcagtcttcgnggctacacctcgaccggcgtactactcctacctacggtgggtcgccgtacgacccgggtccccgtagggaaccgaagggtcgttggaggtcggaggtgggagtggactaccaaccccctaagagtgggtacgacaaaactaactgngacgacgtagtacgttcggagggcgaggtcacgagtcgacgagggaaccaccggtcactacgacgaccacgacgtaccgtacgtaggtacggacgttaccgtcggaccgacgtaacgggtacctacggtaaaccttaacgttcccgggtaacggaacccgttaccggtaacccgggtttaaccctttaaacggtttttaaccgtttacccgggttgggttaaccggtaacggggtttacgggttaaccggtttttaacccgggggttttccggggtttacggggtttcccgggttttttaaccggggttttttttccccgggg

SEQ ID NO: 348818 - DNA, 585 bp, Homo sapiens
  misc_feature: GZ8MTXP01EXFA9.45.37.D04.1.454.CMB.2.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (351)..(351): a, c, t, g, unknown or other
  misc_feature (351)..(351): n is a, c, g, or t
  modified_base (371)..(371): a, c, t, g, unknown or other
  misc_feature (371)..(371): n is a, c, g, or t
  modified_base (412)..(412): a, c, t, g, unknown or other
  misc_feature (412)..(412): n is a, c, g, or t
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
  modified_base (477)..(477): a, c, t, g, unknown or other
  misc_feature (477)..(477): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcaactggtgcagtcgtggggctggaggtgagagcgtgggctnagtgagtctctgcaggctntggctacaccttcaccggcgactatcctccgacgtgggtcgccgacgacggccccctagggaacaacggggtcttaggagtggagtgggatggactaccaaccctaanagtggtagacaacaaaactntgacaacgagtaacgtttcgacggggcagggtaccacgtanacgacgagggactacgtcatcagcacgacgccctaagngtggancgtagacgcgagactcgaacnctacgtaggaaccgacgaccggtacctttagtttacttaacggttgttcggacgggtaagtgttcgggtttaccgggtggttccgtttggtttttccccgttaagggg

SEQ ID NO: 348819 - DNA, 557 bp, Homo sapiens
  misc_feature: GZ8MTXP01B1100.45.37.D04.1.454.CMB.2.raw
  modified_base (253)..(253): a, c, t, g, unknown or other
  misc_feature (253)..(253): n is a, c, g, or t
  modified_base (350)..(350): a, c, t, g, unknown or other
  misc_feature (350)..(350): n is a, c, g, or t
  modified_base (363)..(363): a, c, t, g, unknown or other
  misc_feature (363)..(363): n is a, c, g, or t
  modified_base (424)..(424): a, c, t, g, unknown or other
  misc_feature (424)..(424): n is a, c, g, or t
  modified_base (463)..(463): a, c, t, g, unknown or other
  misc_feature (463)..(463): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctcctgcaggcttcnggctacacctcgaccggcgactatcctccacgtgggtgcgacacggcccctaggacgaagggcttggaggtggagtgggatggatcgaactactaanagtggtgaacaanaactatgacacgagtaagttcgagggcagggtcacagtcgaaccgagggaccacgtaccanacacgacaccgacgggaccccttagagtacgggatccgngacgaccgagtacccgtagactacgtcgagaaccgacgaccggtactatttagttcgttgtgcgaagtagtcggttacggtcgttcgttttcgg

SEQ ID NO: 348820 - DNA, 666 bp, Homo sapiens
  misc_feature: GZ8MTXP01BDHPJ.45.37.D04.1.454.CMB.2.raw
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (281)..(281): a, c, t, g, unknown or other
  misc_feature (281)..(281): n is a, c, g, or t
  modified_base (289)..(289): a, c, t, g, unknown or other
  misc_feature (289)..(289): n is a, c, g, or t
  modified_base (330)..(330): a, c, t, g, unknown or other
  misc_feature (330)..(330): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaacgccgtggggcctgagtgaaggtctctgcaaggcttcgnggctacnccttcacggcgactatctccngtgggtcncgacgacggccccgtaggacgagggtcttggacggtagggngtagggagtacggactaccgtaaacctaaaccgaggtgggtagaccaaactaaaacgtatggacctaaagagttaacgttcgaggggacgtacgggtaccaaccgagtacggaaccgagggaccgtaaccggtaccctagtaccgaacggaccaaccgaacgtaccctaacggaacgttcggggaacgttccggagaaccgcgaacgtacgtaacggtacctacgtacgtcgaacgtaaccggaccggtacttacgtttaactacgttagttcggacggttaagtacggtttcgggtttaccggtcggttacgtttcggtttttcgtttaaccggg

SEQ ID NO: 348821 - DNA, 628 bp, Homo sapiens
  misc_feature: GZ8MTXP01CQNS9.45.37.D04.1.454.CMB.2.raw
  modified_base (480)..(480): a, c, t, g, unknown or other
  misc_feature (480)..(480): n is a, c, g, or t
  modified_base (506)..(506): a, c, t, g, unknown or other
  misc_feature (506)..(506): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctgagtgaaggtctctgcaggcttcgtggctacacctcaccggcgactatcctccacgtgggtcgcgacgacggccccgtaggaacgaacggggtcttagggagggttagggaggttggggaattacgggtactacccgtaaaaccccccgtaaacgaaaggtcgggtacggaccaaaaacgtaaacctgtacgacaacgtaggtaagtttcggagggtacgagggtacaccgagtacgaccgaggacaccgtcancagcacacgctacgagtggaactcgngagcagtactgaacgtctcgaagaccgacgtaccggacttaaagtttcttaccgttgttaccgggaacgtaaggttaacgttcgggtttaccgggttcgttccgtttcgggtttttaacccg

SEQ ID NO: 348822 - DNA, 615 bp, Homo sapiens
  misc_feature: GZ8MTXP01DEJBR.45.37.D04.1.454.CMB.2.raw
  modified_base (231)..(231): a, c, t, g, unknown or other
  misc_feature (231)..(231): n is a, c, g, or t
  modified_base (241)..(241): a, c, t, g, unknown or other
  misc_feature (241)..(241): n is a, c, g, or t
  modified_base (243)..(243): a, c, t, g, unknown or other
  misc_feature (243)..(243): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (272)..(272): a, c, t, g, unknown or other
  misc_feature (272)..(272): n is a, c, g, or t
  modified_base (279)..(279): a, c, t, g, unknown or other
  misc_feature (279)..(279): n is a, c, g, or t
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagacgcccactcccaggtgcagcgtgggtgcaggtcgtggggctggaggtgaggacgcgtgggctnagtgacgtcncngcagctgngctacncctcacgcactatcncagtggngcgacgcgccgtaggacgaagggtctggaggtggagtgggataggataccaaaccccctagaagtcggtacggacctaaacgtaaactgtacgacaaacgtacggtaaagtttacggagggacgtaacgggccaccgtaagtacgaaccgaacggggaactaccggtaccagtaccaacgaccgaaccaacgccgtaaacgtggaacgggacgtccgaggaaccgataacgaccgnggtaaaccncgtacgaacgaacgttaacgtcgttacgttattacgttacgttggttagaacggtagttcgttcgggtcggttcgttcgtttccggtttcg

SEQ ID NO: 348823 - DNA, 729 bp, Homo sapiens
  misc_feature: GZ8MTXP01B6W93.45.37.D04.1.454.CMB.2.raw
  modified_base (254)..(254): a, c, t, g, unknown or other
  misc_feature (254)..(254): n is a, c, g, or t
  modified_base (386)..(386): a, c, t, g, unknown or other
  misc_feature (386)..(386): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagacgcccactcccaggtgcagctggtacagtcgtggggctgagggtgaggaagccgtggggcctcgagtgaagtctcgtgcgaaggtcttntggctacaccttccacggacgtactactcctccgacggtcgggtcgcgaccgacggccccgtggaacgaagggcttggagtggagtggataggactacaaaccctaacaagtcggtaggacaacaaactaanacgaacaacgtaaggtacgtttacggacgggacgacgggtaccaacccgtagtaccggaccggaaacggggacctaacggtacccaacgtaccaacggaccaaaccgacctaaccgtaaccgaaggggttcgggaacggtccggttaaggaaccgtacgaaacggtaacgtacgaaccgtagtaccggtaccggaaaccgaacccggtaacggttaacctttaacgttttaaacgtttaccgtaggttaccgggttaggttacgggttaaggttttacgggtttaaccggggttcggttcggtttttaccgggtttttaacgtttttaacggggaacccgggg

SEQ ID NO: 348824 - DNA, 648 bp, Homo sapiens
  misc_feature: GZ8MTXP01BXMD1.45.37.D04.1.454.CMB.2.raw
  modified_base (165)..(165): a, c, t, g, unknown or other
  misc_feature (165)..(165): n is a, c, g, or t
  modified_base (187)..(187): a, c, t, g, unknown or other
  misc_feature (187)..(187): n is a, c, g, or t
  modified_base (245)..(245): a, c, t, g, unknown or other
  misc_feature (245)..(245): n is a, c, g, or t
  modified_base (257)..(257): a, c, t, g, unknown or other
  misc_feature (257)..(257): n is a, c, g, or t
  modified_base (463)..(463): a, c, t, g, unknown or other
  misc_feature (463)..(463): n is a, c, g, or t
  modified_base (486)..(486): a, c, t, g, unknown or other
  misc_feature (486)..(486): n is a, c, g, or t
  modified_base (492)..(492): a, c, t, g, unknown or other
  misc_feature (492)..(492): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccanaagacgcccacctcccgaggtncagcgtggtgcagtcgtgggctggaggtgaggagcgtgggcctgagtgacgtctacgngacgagtctcgngactaccacctcgaccggcgactatccgccgtacgtgggcgacgccggaccggtccccgtaggaacggtaaggtcgtaggaggtggagtagggatagtactaccccgaaacctagaggtggacgaaccaaagtaactagtacgactaagagttaacggtcgagggtacaaggtccaacgtagacgaacgaacgggcctacgtcacngacgactcgacgtacctagtagnggtacncggtgaccgtacgacgtaccctagaaactcgtaaccgtacggaaacgtaccggttacgttcctttaaaagttttaccgttcgttcgggggtaatacggggttcggtttacgggtttacgggtttcccgggttcggttttccggtttttaaccgggg

SEQ ID NO: 348825 - DNA, 705 bp, Homo sapiens
  misc_feature: GZ8MTXP01AIQBM.45.37.D04.1.454.CMB.2.raw
  modified_base (247)..(247): a, c, t, g, unknown or other
  misc_feature (247)..(247): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctgaggtgaggagcgtgggcctgagtgagtctcgtgcagtctcgnggctactacctcgaccggcgtactactcctaccacgtcgggtcgccgacgaccggtccccgtaggaacgtaagggtcgttaggaggtacggtaggtggggtatagggaactaaccgaaacccccctaaagaggttacgggtacggaaccaaaaaccgtaaacgtaagtacgaaccgtaaacgtaaacggttaacggtttacggaacggggtaccgacggggttaccaacgtaacgtaccggaaacccggagggaaccctaaccgtaccgacgtaccgacgaccaacgtaccgaccgttaacgaggttcggacgtaccgtggaacgtacgaacgtacgtacgaactacgtccgtaacgaaccgttacgtaccggttacttaacgtttacgttcgttggttacggtaacgtaggtaacgtttcgggtttacggttcggtttcgtttcggttttaacccgg

SEQ ID NO: 348826 - DNA, 635 bp, Homo sapiens
  misc_feature: GZ8MTXP01B0446.45.37.D04.1.454.CMB.2.raw
  modified_base (396)..(396): a, c, t, g, unknown or other
  misc_feature (396)..(396): n is a, c, g, or t
  modified_base (575)..(575): a, c, t, g, unknown or other
  misc_feature (575)..(575): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagccccactcccaggtgcagctggtgcagtcgtggggctggaggtgaggaagccgtggggcctcagtgaaggtctctgcaggctctggctacaccttcgaccggcgactatcctccgacgtgggtcgcgaccacggggccccctaggggactaaggggcttacggaggtcgggagtggggatacgggtataccgaaaccctaaccaagttgggtaggaccaacgaaaaactntgctaacgagtaacgtttcgagggcgagggtacaccagtacgaccgaagggacaaccgtacacgtcaggccaacgtagcccgtaacgagttcgggaacgtccgtggaacgccgagtaaccgtcgaacctagtccgtaggaaccgtaaccgccgggtaccttaagttttactaccgttgnggttaccgaaggtagtttcggttaccggttggttccgtttcggttcccgtttttaacggg

SEQ ID NO: 348827 - DNA, 667 bp, Homo sapiens
  misc_feature: GZ8MTXP01DGDAZ.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcgtaggtttggggctgaggtggaggaagccgtggggcctgagtgaaggtctctgcaggtcttctggctacaccttcgaccggcgactatcctccgacgtgggtcgcgacgacggtccccctaggaaccgaagggtctggaggtgggagtcgggatggactacaaaccctaacagtggtaggacaactaaaaactatcgacaacgtaaggtaacgtttcgacggggcgaacgggtactaacgacgtacggaaccgacggggtacaaccgttacccaataccgaagaccaacgacgaccctaacggagttggaagcgtagaacgccgaagaccgtgaacctactcgaacggaacgaaccgaccggtaccttaattttaacgtaacgtttcggttcggttaaccggtaagggttaaacgtttccgggttttaaccggggtcgtttaccgggttttcggttttcccggtttttaacgggg

SEQ ID NO: 348828 - DNA, 728 bp, Homo sapiens
  misc_feature: GZ8MTXP01DHBGJ.45.37.D04.1.454.CMB.2.raw
  modified_base (381)..(381): a, c, t, g, unknown or other
  misc_feature (381)..(381): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaacgccgtggggcctcgagtgaaggtctcctgacaaggtcttcgtcggctacacctccgaccggcgtaactctcctaccgacgtgggtcgccgacgacggccccgtaggaacgaagggtctttggaggttggagtggggataggactaccgtaaacccccctaaanaaggtggtcggaaccaaaactaaaccttaagtacgaaccaaacgtaaggtaacgtttacggagggtaccgaaggggtaccaaccgtagtacggaaaccgaggggaacctaccggttaaccacgtacgaacgacccaacgaccgaccgtaacgtaacggttacgggaacgaccgtggaaccgacgaaaccggtactacggtaacacgtcggttaaccgaaccggaaccgtaaacccgggttaccctttaaagttttaacgtttaaccgttggttaccggtaaggttaaggtaacgttttacggggtttacccggggttggttccggttttcgggttttttaacccggg

SEQ ID NO: 348829 - DNA, 567 bp, Homo sapiens
  misc_feature: GZ8MTXP01AVEJZ.45.37.D04.1.454.CMB.2.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (332)..(332): a, c, t, g, unknown or other
  misc_feature (332)..(332): n is a, c, g, or t
  modified_base (353)..(353): a, c, t, g, unknown or other
  misc_feature (353)..(353): n is a, c, g, or t
  modified_base (520)..(520): a, c, t, g, unknown or other
  misc_feature (520)..(520): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcgtgggcctnagtgaggtctctgcagcttcngctacnctcaccgcgactatctcacgtggtgcgacgacgcccctggacgaagggtctggagtggagtggatggatcaaccccgtaanagtggtcgacaaactaaactntgacacgaagtaacgtttcgagggtcacgggtcacgagtacgaccgagggaccacgtcactacgagccacgacgctaacgagtaggagtccgaggagacgacggtacctggaactacgtcgtaaggaaccgacgtaaccgttcctaagtttacttacgttgttacgnggtacggtaacgttcggttacgggttcgttcgtttggttttaacccg

SEQ ID NO: 348830 - DNA, 727 bp, Homo sapiens
  misc_feature: GZ8MTXP01ALH9D.45.37.D04.1.454.CMB.2.raw
  modified_base (182)..(182): a, c, t, g, unknown or other
  misc_feature (182)..(182): n is a, c, g, or t
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (270)..(270): a, c, t, g, unknown or other
  misc_feature (270)..(270): n is a, c, g, or t
  modified_base (366)..(366): a, c, t, g, unknown or other
  misc_feature (366)..(366): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtncagctggtgcagtctggggctggaggtgaggagcgtgggcctngtgaaggtctctgcagcttcnggctacnctcaccggcactatccnccagtggtgccgacgaccggccccgtaggacgtaacgggtccgtttaggaggttggtaggtggggtatgggtaactaccgtaaaccccccctaaanaggttcgggaggaaccaaaacctaaacgttaacgtacggaactaaaccgtaaggttaacggttttacgggaaggggtccgaacggggttaccaaccggttacgaccgggaaccgaaggggaacccaccggtaccctataaccggacgaccctaaaccgaccggtacctaaacgtaacggttgggaaaccggttccgtaggaacgtcgtaaaacggcgtacggaactaccgttcggtaaaccggtaacgaccggtaaccggttacctttaagttttaacgttacggtttcggaccggtggtaaacggtcggttttacgggtacccgggtttggttaaccgtttttcgggtttttaacccggg

SEQ ID NO: 348831 - DNA, 533 bp, Homo sapiens
  misc_feature: GZ8MTXP01A1MT3.45.37.D04.1.454.CMB.2.raw
  modified_base (317)..(317): a, c, t, g, unknown or other
  misc_feature (317)..(317): n is a, c, g, or t
  modified_base (373)..(373): a, c, t, g, unknown or other
  misc_feature (373)..(373): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
  modified_base (447)..(447): a, c, t, g, unknown or other
  misc_feature (447)..(447): n is a, c, g, or t
  modified_base (479)..(479): a, c, t, g, unknown or other
  misc_feature (479)..(479): n is a, c, g, or t
  modified_base (529)..(529): a, c, t, g, unknown or other
  misc_feature (529)..(529): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccacatcaactgacaagtccagccagtagttgtttagacagctacaacaataagaactactagcttggtaccagcaagaaaccaggtcagcctacaagctgctactatttacgngggtacagtccgtaccgggacgtcccgggggtcccctggacgtatcgagtcgggcnggcgggtcgagggacagtacttcactctacacatcagcacgcctgcgagntagaagtntggggngtactagttntgctgtcagtctaagttattattatcttaccncgttacgttccgccgtaggacttaagctaactataactacgaagacttgngtcc

SEQ ID NO: 348832 - DNA, 630 bp, Homo sapiens
  misc_feature: GZ8MTXP01AFBWY.45.37.D04.1.454.CMB.2.raw
  modified_base (254)..(254): a, c, t, g, unknown or other
  misc_feature (254)..(254): n is a, c, g, or t
  modified_base (293)..(293): a, c, t, g, unknown or other
  misc_feature (293)..(293): n is a, c, g, or t
  modified_base (384)..(384): a, c, t, g, unknown or other
  misc_feature (384)..(384): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtgggcctgagtgaaggtctcctgacaggtcttcgnggctacacctcgaccggcactactcctccacgtgggtcncgacgacggccccgtaggaccgaagggtcttaggagtggagtgggatggactaccaaacccctaagaggtggtacggacaaaacaaacgtntacgacaacgtaggtaacgtttcgagggacgagggtaccaaccgtagtaccggaaccgaggggaaccacggtacccagtaccgagactacgacgacctaagagtggacgcgtaggaacacgacggtactacgaactacgtacgaacgaaccgacgtaccggttaccgttaatttacgttacgttggttacggtaacggtaggtaacgtttcgggttacggttcggttcgtttaacgggttttccgg

SEQ ID NO: 348833 - DNA, 666 bp, Homo sapiens
  misc_feature: GZ8MTXP01ASH7V.45.37.D04.1.454.CMB.2.raw
  modified_base (252)..(252): a, c, t, g, unknown or other
  misc_feature (252)..(252): n is a, c, g, or t
  modified_base (352)..(352): a, c, t, g, unknown or other
  misc_feature (352)..(352): n is a, c, g, or t
  modified_base (534)..(534): a, c, t, g, unknown or other
  misc_feature (534)..(534): n is a, c, g, or t
  modified_base (632)..(632): a, c, t, g, unknown or other
  misc_feature (632)..(632): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagcgtggtgcagtcgtggggctggaggtgaggaagccgtggggcctgagtgaggtctcctgcaggcttcnggctacacctcaccggctactatcctccacgtgggcgcgacgacggccccgtaggacgaagggtctaggagtggagtgggatggataccgaaacccctanagtggtcgacaaaacgaactgtcgaccgagtaagtaacgggtttacgagggggtaccgtacggggtacctaaaccgagtacggaacccgaggggaaccacccggttaccaagtacgacgaccaacgaccgaccgttaagacggtagacggtcgtacggacgtacaacggcgttacgaacctnttacgaaccggacgaaacccggtaccggttacccttaagttttaacgttccgttggttcggtaacgggttaggttaacggtttcgggtttacccgggnggggtttcccgtttttaacggggtttttcccggg

SEQ ID NO: 348834 - DNA, 572 bp, Homo sapiens
  misc_feature: GZ8MTXP01DYVX3.45.37.D04.1.454.CMB.2.raw
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
  modified_base (334)..(334): a, c, t, g, unknown or other
  misc_feature (334)..(334): n is a, c, g, or t
  modified_base (357)..(357): a, c, t, g, unknown or other
  misc_feature (357)..(357): n is a, c, g, or t
  modified_base (416)..(416): a, c, t, g, unknown or other
  misc_feature (416)..(416): n is a, c, g, or t
  modified_base (442)..(442): a, c, t, g, unknown or other
  misc_feature (442)..(442): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctgagggtgaggaagccgtggggcctcagtgaggtctctgcaggctngctacnctcacgnactnctcactggncgacgacggcccctggacgaaggcttggagtggagtgggattggataccgaaaccctaanagtgggtcgacaacgaaaaactntgacctaaagacgtaagttcggaggcacgggtaccacgatacgacgaggacacgtccancgagcaacacgacctagacgtggacncgagacgcaagtaccgtgaacctagtcgtcgaaaccgacgttaccggtactttaatttaaccgtgttagttcggacggttaaggtacgtttcgggtttacggcggttgtttcgggttttcgtttaacggg

SEQ ID NO: 348835 - DNA, 680 bp, Homo sapiens
  misc_feature: GZ8MTXP01CL3GZ.45.37.D04.1.454.CMB.2.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtgggcctnagtgagtctctgcagcttnggctacnctcacggcgactatctccacgtgggtgcgtacacggccccctgggaacgtaacgggtcttaggagggttacggagttagggggacttagggactacccgtaaaccccctaaacgtaaaggtcgggtacggaccaaaaaaccgtaaaacttcgaggaaccaacgtaaacggtaacgtttaccggggaggggacccggtaacgggtaccaaccgtaggaaccggaacgggaacggtaacgtacccgtacgaacgtacgacgacctaacgaccgtaccgtacgtaaggtcggacgacgtagacgaccgaagtacgctacgtacttccggaagaccgacgaccgttacctttaaagtttacttacgttggttagtaacgggtagttcggtttacgggttacggttcgtttaacgttcgggtttttaaccgg

SEQ ID NO: 348836 - DNA, 623 bp, Homo sapiens
  misc_feature: GZ8MTXP01E1GNQ.45.37.D04.1.454.CMB.2.raw
  modified_base (227)..(227): a, c, t, g, unknown or other
  misc_feature (227)..(227): n is a, c, g, or t
  modified_base (248)..(248): a, c, t, g, unknown or other
  misc_feature (248)..(248): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctnagtgaaggtctctgcagctcngctacacctcaccggcgactactctccacgtgggtcgcgacgacggcccctggacgaagggcttggagtggagtggggatggactaccaaaccccccctaacagtgggtacggaccaaaaccaaaccgtgtacggaccaacgtaagtaacgtttcggaaggggtccgtacggggtaccaaccgaagtacggaaccccgaagggggaacccaccggtcccaagtccacgccaacgacgccctaacagtcgggacgcgtgagccagactgaaccatccgaagaaccgacgaccggccttaagtttacttacgttggttcggaacggtaggtaacgttcgggtttacccggttggttccgtttcggtttttaacccgg

SEQ ID NO: 348837 - DNA, 661 bp, Homo sapiens
  misc_feature: GZ8MTXP01EF2J8.45.37.D04.1.454.CMB.2.raw
  modified_base (465)..(465): a, c, t, g, unknown or other
  misc_feature (465)..(465): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagacgcccactcccaggtgcagctggtgcagtctggggctggaggtgaggagccgtggggcctgagtgaaggtctcctgacgaaggtcttcgtggcctactaccctccgaccggcgtactactctccgacgtgggtcgacgacgacggccccgtggaacgaagggtcttaggagttaggagtgggactaggactaccaaacccccctaagagtgggtacgacaaacaaactcgtacgacaacgtaagtaacgtttcggagggcgtagggtacaactagacgaccgagggaccacgtacanacgacgacaacacgacctaagtacgtaggacgcgtaggaacgcgaacggtactacggaactacgttaccgaacggaaccgaaccgtaaccgggttacctttaaagttttaacgttaccgttgggttacgtaaccgggtaggttaacgtttacgggtttaccggttacgggtttccgttttcggtttttaacccggg

SEQ ID NO: 348838 - DNA, 630 bp, Homo sapiens
  misc_feature: GZ8MTXP01CB7DV.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctcagtgaaggtctctgcaagcttcgtggcctacacctcgaccggcgtactatctccacgtgggtgccgacgaccggccccgtaggaccgaagggtcttggacggtggagtgggatggatacctaaacccttaacagtggtaggaccaaaactaaactgtacgacaaacgtagtaacgtttacgacggggtcgacggggtacaccgagtacgaccgtaagggaccgacgtccacgtcacgcgaacacggacctaacgtaggtagggacgtcgtacgacgacgaacgtacctagacgtctcgaagaccgaccgtaccggttaccttaagttttacttacgttgttacggtaacggaggttcggtttcggtttacgggttcggtttccgtttcggtttttaacccgg

SEQ ID NO: 348839 - DNA, 605 bp, Homo sapiens
  misc_feature: GZ8MTXP01AUDBX.45.37.D04.1.454.CMB.2.raw
  modified_base (249)..(249): a, c, t, g, unknown or other
  misc_feature (249)..(249): n is a, c, g, or t
  modified_base (346)..(346): a, c, t, g, unknown or other
  misc_feature (346)..(346): n is a, c, g, or t
  modified_base (373)..(373): a, c, t, g, unknown or other
  misc_feature (373)..(373): n is a, c, g, or t
  modified_base (474)..(474): a, c, t, g, unknown or other
  misc_feature (474)..(474): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaggtctctgcagcttcngctacactcaccggcactatctcacgtgggtgcgacacggcccctggaccaagggcttaggacgtggagtgggatgggaatccgaaaacccccctanaagtgggtaggaccaaaacaaaccttnggaccaacgtaagtacgtttcgaggggcacggggtcaacgagtcgaacccgaggggaaccacgtaccaatcgacgacactacgcctacgagtggaactcgngaagcgagactacgactatccgaaggaccgttacgacggttacccttaaagttttattaccgttggttacgtccgggtaagtcggtttacggtttaccggggttcgtaacggttttggtttttaaccccgg

SEQ ID NO: 348840 - DNA, 705 bp, Homo sapiens
  misc_feature: GZ8MTXP01EZCJG.45.37.D04.1.454.CMB.2.raw
  modified_base (253)..(253): a, c, t, g, unknown or other
  misc_feature (253)..(253): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctcctgcaggcttcnggctacacctcgaccggcgactatcctccacgtgggtcgccgacgacggccccctagggaaccgaacggggtcttaggaggttagggagtggggatagggactaccgaaacccccctaaacgaagtttggggacggaccaaaaacgtaaactgtacgaaccaaccgtaaaggtaacgtttacgggaggggaccgtacggggtaccaaccgtaagtacggaacccggaggggtaaccctaaccggttacccaagtacccgacgacctaaacgaccggtaccctaacgtaagttccgggaagtaccgaggaacgacgtaacgaccgtcgaacacgttaccgaacgaacccgttaaccgaccggttaccttaaatttaacgttacgttgggacgtaaccggtaggttaacgtttcggggtttaccggttgtttcggttttcggtttttaacccgg

SEQ ID NO: 348841 - DNA, 651 bp, Homo sapiens
  misc_feature: GZ8MTXP01ASEH0.45.37.D04.1.454.CMB.2.raw
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (474)..(474): a, c, t, g, unknown or other
  misc_feature (474)..(474): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggagatcctcttcttggtggcagcagccaacaagacgcccactcccaggtgcagcgtggtgcagtcgtggggctggaggtgaggacgccgtgggcctgagtgaggtctctgcagcttcgngctacnctcgcgacgtactactcgtccacgtggtcgacgcgaccggcccgtggacgaggtcgttggaggtggagtcgggatacggactaccaaacccctaacaggtaggtcgacgtaaaaacaaaccgtaagtagaccaaacgtaagtaacgggtttacgacgggtacgacgggtaaccaaccggtagtacggaacccgggacgaaccggtactacccgaanaccgacgacaacgacccgaaccgttaagacgtaggacgtcgacggcgaccgaaggcttaacaccgcgttacgaacgtacccgaacggaccggttaacgttactttacggttacgttggttacggtggtaacggttcgttacgggttacggttcgttaacggtttcgtttttaaccgg

SEQ ID NO: 348842 - DNA, 639 bp, Homo sapiens
  misc_feature: GZ8MTXP01AX0BM.45.37.D04.1.454.CMB.2.raw
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
  modified_base (455)..(455): a, c, t, g, unknown or other
  misc_feature (455)..(455): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagtagccacaagacgcccactcccaggtgcagctggtgcagtcgtggggctggaggtgaggagccgtgggcctnagtgagtctctgcaggcttgngctacacctcaccgcactatctcacgtggtgcgacgacggccccgtaggacgtaagggtcttaggaggtggacgtggggtatggaactaccaaacccgtaaacgagtacggacggacaactaaactaagtacgcaacgtaaggtaaacggtttcgaaggggtacgacgggtaccaacgagtacggaaccgagggaccaccgtacctancgacgaccaacgaccgacctacgagggtggacgtcctaggacgcgaacgacgtagactactaccgacgaaccgtaacgaccggttacttaaagtttacgtaacgtcggttacggttcggttaacggttaacgttacgggtttcggtacggttcgtttaccggttttcgtttaacggaacccggg

SEQ ID NO: 348843 - DNA, 562 bp, Homo sapiens
  misc_feature: GZ8MTXP01E0BNP.45.37.D04.1.454.CMB.2.raw
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (273)..(273): a, c, t, g, unknown or other
  misc_feature (273)..(273): n is a, c, g, or t
  modified_base (286)..(286): a, c, t, g, unknown or other
  misc_feature (286)..(286): n is a, c, g, or t
  modified_base (325)..(325): a, c, t, g, unknown or other
  misc_feature (325)..(325): n is a, c, g, or t
  modified_base (466)..(466): a, c, t, g, unknown or other
  misc_feature (466)..(466): n is a, c, g, or t
  modified_base (478)..(478): a, c, t, g, unknown or other
  misc_feature (478)..(478): n is a, c, g, or t
  modified_base (498)..(498): a, c, t, g, unknown or other
  misc_feature (498)..(498): n is a, c, g, or t
  modified_base (530)..(530): a, c, t, g, unknown or other
  misc_feature (530)..(530): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagtagccacaagagccccactcccaggtgcagctggtgcagtcgtggggctgaggtgaggagccgtgggcctgagtgagtctctgcaggcttcnggctacnccttcgaccggcgactatcnccacgtggggtcncgacacggccccgtggaccaagggcttgagtggatgggntggatccaacctaacatggtgacacaactatcgcacgagtacgttcgagggcagggttcaccgatcgacgaggtacacgtacccatcgagcacacgcctacaggtggaatccgtagacgcgaacgacgtcgactataccgnggaacccgtaanaccggttcctaagttttacncgtagcggacgaggtctaggggtttaacccgnggtaccgttggttttcccgtttggaacccggg

SEQ ID NO: 348844 - DNA, 675 bp, Homo sapiens
  misc_feature: GZ8MTXP01CJ6N1.45.37.D04.1.454.CMB.2.raw
  modified_base (290)..(290): a, c, t, g, unknown or other
  misc_feature (290)..(290): n is a, c, g, or t
tcagacgcgatcgacacgaccggtgctcgattttagtagcatactgttggggtttgggggcatcaccccagcaaaccacatctgtcctctagagaatccccctgagagctccgttcctcaccatggactggacctggaggatcctcttcttggtggcagcagccacaagagccccactccccaggtgcagctggtgcagtctggggctgaggtggaggaagccgtgggggcctcgagtgaaggtctccgtgcaaggcttctggctacaccttcaccggcgactatctccnctgggtgcgacacggccccctgggacaagggcttggagtggagtgggatggatcgaacctaacaagtggtggtacaacaaaaaacttatgacaacgaggtaacgtttacgaaggggtacaacggggttccaaccgaagttacggaaccccgaaggggaacccgaccgggttaccctaagttacccaggaccctaacacggtaccccttaacggacgttagggaacgtccgtagaacgcaaggacctgaactaacgtcgtcggaaccgacgaaaccgggaccttaacgttttaaacgttaaccgttggtttcggaccgggtaagggtcgttaacgggttttaacccgggtgggttaccgtttcgggttttcccgtttttaaccggg

SEQ ID NO: 348845 - DNA, 612 bp, Homo sapiens
  misc_feature: GZ8MTXP01BAMJN.45.37.D04.1.454.CMB.2.raw
  modified_base (357)..(357): a, c, t, g, unknown or other
  misc_feature (357)..(357): n is a, c, g, or t
  modified_base (381)..(381): a, c, t, g, unknown or other
  misc_feature (381)..(381): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcgagtgaaggtctcctgcaaggcttctggctacacctcaccggcgactatcctccacgtgggtcgcgacacggccccctaggacgaaggggcttggagtggagtggggatggaactaccgaaacccccctaanaagtgggtacgacaaaacaaactncgacacaagtaacgtttcgacggggcacgggtcaccgagtcgaccgagggacacggtccatcacgcaacgtacgacctaacgagtacgggacgtccgagacgccaaggctagactactcgaagaaccgaccgacggttccttaaagttttaccttagttggttacggccggtaaggttaacgtttaccggggtttaccgggttcggttcgttttaacgggttttttcccgg

SEQ ID NO: 348846 - DNA, 642 bp, Homo sapiens
  misc_feature: GZ8MTXP01DOSNB.45.37.D04.1.454.CMB.2.raw
  modified_base (591)..(591): a, c, t, g, unknown or other
  misc_feature (591)..(591): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcaggtctggggctgaggtgaggagccgtgggctcagtgaaggtctcctgcaggcttctggcctacaccctcgaccggcgactactctccacgtggtcgcgacgaccggccccgtaggaacgaagggtcttggaggtggagttgggatggatccaaaccccgtaacaagtggtaggacaaaaccgtaaactaagtacgtacgaaacgtaaacggtaacggttacgtacgggggacgtacggggtaccgaaccgtaacgtacggaaccggaacgggaaccgtaacggtaccactacgacgactacacgacctacgagtcgggacgacgtgacgacgaaacgtacgtacgactactcgtaacggaccgaccgtaaccggttaccgtaattttacttacgttgnggaacggtaggtgtttcggttacgggttcgttcggtttcgttttaaccggg

SEQ ID NO: 348847 - DNA, 686 bp, Homo sapiens
  misc_feature: GZ8MTXP01B9O78.45.37.D04.1.454.CMB.2.raw
  modified_base (535)..(535): a, c, t, g, unknown or other
  misc_feature (535)..(535): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagccccactccccaggtgcagctggtgcagtcgtggggctgaggtgaggaagccgtggggcctcgagtgaaggtctcctgcgaaggtcttcgtggctacctaccttcgaccggcgtactactcctccgtacgtggggtcgacgaccgaccgggtcccccgtagggaccgaaacggggtcttagggaggtagggaggtgggataggactaccgaaaccctaaacgaagtgggtacgaccaaacaaaaactagtcgacaacgtaaaggttaacggttacggaacggggtccgaaggggtcccaaccgagtacgaaccggaacgggaccaccgtaccataccgaacgccaacgacgaccctaagagtcgggacncgagacgacacgtactcggaactacgtccgtaacggaaccgaaccgttaccggtaccttagttttaacgttacgttggttcgttacgggtaaggttacgtttccgggtttacgggtcggttaccgttttccgggttttccgtttaacgggg

SEQ ID NO: 348848 - DNA, 738 bp, Homo sapiens
  misc_feature: GZ8MTXP01CJUPJ.45.37.D04.1.454.CMB.2.raw
  modified_base (254)..(254): a, c, t, g, unknown or other
  misc_feature (254)..(254): n is a, c, g, or t
  modified_base (294)..(294): a, c, t, g, unknown or other
  misc_feature (294)..(294): n is a, c, g, or t
  modified_base (506)..(506): a, c, t, g, unknown or other
  misc_feature (506)..(506): n is a, c, g, or t
  modified_base (720)..(720): a, c, t, g, unknown or other
  misc_feature (720)..(720): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtggcgagacggccacatcaactgacaagtccagccagtagttgtttagacagctacaaanaataacgaactactagctacgtacaagacaacgaaaccgngtacacgtccctaccgtaagctcgacttacgtaactttacggtcggtacctacgttacccggtaaaccccggggtaaccggttccccgggggttacccccctaggtacgttaccggtaacgtttacgaaacgggttcgggccgtaacggggtcggggtacggttacggggaactaacggttacctttacgacccttcctaaccaaacccgtntaccgaacggccgtaacgcccgtggaccgaggtactaaggaaacgttgtacgggttcggtacttaggtttctggcttacgtacgtaacgtaattaagtttaatttaacttaagtttccccttcccggttaacgtttccccgttaccgggtaaccccggttaagggttaaacccgttaaagggttcgtaaaacttaacgaaaccgaaaccggttntaacggggttcgtaaccg

SEQ ID NO: 348849 - DNA, 566 bp, Homo sapiens
  misc_feature: GZ8MTXP01B1DMB.45.37.D04.1.454.CMB.2.raw
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
  modified_base (377)..(377): a, c, t, g, unknown or other
  misc_feature (377)..(377): n is a, c, g, or t
  modified_base (436)..(436): a, c, t, g, unknown or other
  misc_feature (436)..(436): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcagtgaaggtctccngcaggcttcnggctacacctcgaccggcgactactctccacgtgggtgcgacgacggccccgtgggacaagggcttggaggtggagtgggatggataccaaaccccctaaacaagtgggtacgacaaacaaactntgacagaagtaggtttcgagggacgacgggtcacgagtcgacgaggacacgtacatcancactagccaacagtggagtgtgacgcgagactagacacttcgaagacgacgtaacgccgttaatttattacgttcgttgaacgtaggtaacgtttgggttacccggttggttcgtttcggttttaaccgg

SEQ ID NO: 348850 - DNA, 679 bp, Homo sapiens
  misc_feature: GZ8MTXP01BYPBF.45.37.D04.1.454.CMB.2.raw
  modified_base (482)..(482): a, c, t, g, unknown or other
  misc_feature (482)..(482): n is a, c, g, or t
tcagacgcgatcgacacgaccggtgctcgattttagtagcatactgttgggtttgggggcatcacccagcaaccacatctgtcctctagagaatccccctgagagctccgttcctcaccatggactggacctggaggatcctcttcttggtggcagcagccacaagacgccccactccccaggtgcagctggtgcagtcgtggggctgaggtgaggagcgtggggcctcgagtgaaggtctccgtgcgaaggtcttcgtggactaccacccttcgaccggcgtactactcctccgacgtgggtcgccgacgacggcccctggacgaagggtctaggaggtggagtgggatacggtataccgaaccctaaagagtcggtagacaacgtaaaaactagtgacgaagtaacggtaaacgtttcggacggggacacgggtaccaacccgagtacggaaccgaacgggaacctaaccgtaccgaaancgaacgacaacgacgacctaacggaagtcgggtacacggtacgacgacggaagaccgtacgaactacgtcgaacggaaccgtaaccgttccggtaacttacgtttaacgtccgttaggttccggttacggtaaggtacggtttccgggtttaacgggttcgggttaccgttttcgggtttttcccgtttaaccgggg

SEQ ID NO: 348851 - DNA, 613 bp, Homo sapiens
  misc_feature: GZ8MTXP01A6AYU.45.37.D04.1.454.CMB.2.raw
  modified_base (253)..(253): a, c, t, g, unknown or other
  misc_feature (253)..(253): n is a, c, g, or t
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
  modified_base (454)..(454): a, c, t, g, unknown or other
  misc_feature (454)..(454): n is a, c, g, or t
  modified_base (458)..(458): a, c, t, g, unknown or other
  misc_feature (458)..(458): n is a, c, g, or t
  modified_base (472)..(472): a, c, t, g, unknown or other
  misc_feature (472)..(472): n is a, c, g, or t
  modified_base (544)..(544): a, c, t, g, unknown or other
  misc_feature (544)..(544): n is a, c, g, or t
  modified_base (586)..(586): a, c, t, g, unknown or other
  misc_feature (586)..(586): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagcgtggtgcaggtcgtggggctggaggtgaggagccgtgggcctgagtgaaggtctcctgcaggtctcnggctacacctccgaccggcgactatccnccacgtgggtcncgacgcggccccgtggacgagggtcttggagtggagtggatggactaccgaaaccccctaagaggttgggacgaccaaaactaaacttgcgacctaagtacgtaaggtttacggagggacgacgggtacaccgtagcgaaccgaggaccacgtcacacganacanacgacctagacggngaacgtgagacgacgaacgctacggactacgtcggaacgaacggactaccggttcttaaaggtttacttagnggttacggtaacggtaggttaacggtttacgggttcccgggngtttccggtttcggtttttaacccggg

SEQ ID NO: 348852 - DNA, 625 bp, Homo sapiens
  misc_feature: GZ8MTXP01CTM6V.45.37.D04.1.454.CMB.2.raw
  modified_base (225)..(225): a, c, t, g, unknown or other
  misc_feature (225)..(225): n is a, c, g, or t
  modified_base (236)..(236): a, c, t, g, unknown or other
  misc_feature (236)..(236): n is a, c, g, or t
  modified_base (362)..(362): a, c, t, g, unknown or other
  misc_feature (362)..(362): n is a, c, g, or t
  modified_base (419)..(419): a, c, t, g, unknown or other
  misc_feature (419)..(419): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtgggcctnagtgaaggtcnctgcaaggcttctggctacacctcgaccggcgactatctccacgtgggtgccgactacggcccctgggaaccaaagggggcttaggagttggagtgggactggataccgaaaacccctaactaaangggtagcaaaacaaaatgtacgacaacagaagttacgagggacgagggtacaccaanacgacgaacggacgacgtacacacacgacaacacgacgtaacagtagacgacgtagagacgaacgaacgtacgaacgtactacgtaacgaacggaaaccgtaaccggttaaccgttaaacgttttaacgtttaacgttcggttacggtaacggtaacgggtaacggttacggtttacgggttacggttcggtttcggttttaaccg

SEQ ID NO: 348853 - DNA, 627 bp, Homo sapiens
  misc_feature: GZ8MTXP01DV4YA.45.37.D04.1.454.CMB.2.raw
  modified_base (450)..(450): a, c, t, g, unknown or other
  misc_feature (450)..(450): n is a, c, g, or t
  modified_base (489)..(489): a, c, t, g, unknown or other
  misc_feature (489)..(489): n is a, c, g, or t
  modified_base (509)..(509): a, c, t, g, unknown or other
  misc_feature (509)..(509): n is a, c, g, or t
  modified_base (569)..(569): a, c, t, g, unknown or other
  misc_feature (569)..(569): n is a, c, g, or t
  modified_base (597)..(597): a, c, t, g, unknown or other
  misc_feature (597)..(597): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagtagccacaagacgcccactcccaggtgcagctggtgcagtcgtggggctggaggtgaggagcgtggggcctcgagtgaaggtctctgacgaaggtcttcgtggcctactaccttcgaccggcgtactactcctccacgtgggtcgacggacgacggccccgtaggaacgaaggtcttaggagtggagtagggatggaactaccaaaaccgtaaactaagtggtacggactaaacaaaacgtaatacgaacgaactaaagggtaaacgttcgaacgggcggacgggtaccaacgtanaggaaccgagggtaccacgtacacacgaacgcaacgtanaccgtaagagtggacgccgngaacgcgacgtacttacggactacgtgaacgacggaacacggttcttaagtttcagttgnggacgttggttaacttcgggttaaccgnggttcgttacgttttcgttaacggaaccgg

SEQ ID NO: 348854 - DNA, 693 bp, Homo sapiens
  misc_feature: GZ8MTXP01BSIBN.45.37.D04.1.454.CMB.2.raw
  modified_base (245)..(245): a, c, t, g, unknown or other
  misc_feature (245)..(245): n is a, c, g, or t
  modified_base (266)..(266): a, c, t, g, unknown or other
  misc_feature (266)..(266): n is a, c, g, or t
  modified_base (388)..(388): a, c, t, g, unknown or other
  misc_feature (388)..(388): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctggaggtgaggacgccgtcgggcctcgagtgaacggtctcgngacgtagtcttcgtgctaccncccgtacgaccggcgtactacgtcctccgacgtgggtcgccgacgaccggccccgtaggaacgaaggtcgttagagggtggagtggagtggactaccgaaaccccctaacgtagtgggtacncaaaactaaatcgtagaccgtaacgtacggtaagtttacggaggggtacccgtacgggttaccgaacctaacgtacggaacccggaagggaacccgtacgtaccctaacgtacgacgaccgactaccgtaccgtaacgtacggtggacggttacgtcggaacgacgaacgtacctacggaacttaccgaccgtaacggaacccgaccgtaccggaccctttaagtttacgttacgttgttacgggaacggttaggtaacgttttacgggttcgggttcggttaacgttttcgggtttttaaccgg

SEQ ID NO: 348855 - DNA, 674 bp, Homo sapiens
  misc_feature: GZ8MTXP01C4GJP.45.37.D04.1.454.CMB.2.raw
  modified_base (253)..(253): a, c, t, g, unknown or other
  misc_feature (253)..(253): n is a, c, g, or t
  modified_base (372)..(372): a, c, t, g, unknown or other
  misc_feature (372)..(372): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccaacaagacgcccactcccaggtgcagctggtgcgtaggtcgtggggctggaggtggaggacgccgtgggcctgagtgagtctctgacagtctntgctactcctcgacggcactctcctccacgtggtcgcgacgacggccccaggaccgagggtcttaggagtggacgtggatggactaccaaaccccgtagagtggtacgacaaacaactncgacacgtagacgttcgagggacaggtaccacagtaccggacgtagggactaccgtacacgtacgacgaccgtaacctaaccggtactaacggtaagtacgggaccgtccgtaaggaccgaacgtaacgggaccttaacggaacctcggttacccgaacgggaacccgttaaacccgggtaccttacccgtttaaagttttcccggttagttccggttacgggtaacggtaaagggtttcggttttacccggggtttaacggggttcttttccgggggtttttccggttttttaacccgggg

SEQ ID NO: 348856 - DNA, 666 bp, Homo sapiens
  misc_feature: GZ8MTXP01DKRKI.45.37.D04.1.454.CMB.2.raw
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
  modified_base (566)..(566): a, c, t, g, unknown or other
  misc_feature (566)..(566): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtgggcctnagtgagtctcngacagctcngctacnctcnccggcactatcncctagtgggtcacgacgcgtccccgtaggaacgtagggtcttaggaggtggagtagggacgtaggactacccgaaaccccctaagaaggttgggtacggaacccaaaacgtaaactgtacgaaccctaaagtaaggttaacggtttacggacggggacggtacgggtacccaacggagtacgaaccggagggtaacctaccgtacacgacgagaccaacgaccgacccgttaaggagtagggacctagacgaggacctaaggactagacctagtcggtaacgaacgaccggtaacnccgtttaaattttcgacgtttgggttaacccggtgggtaaaggttaacgtttccgggtttaccggggttacgtttcggtttttccggtttttaacccggg

SEQ ID NO: 348857 - DNA, 795 bp, Homo sapiens
  misc_feature: GZ8MTXP01DF5AS.45.37.D04.1.454.CMB.2.raw
  modified_base (260)..(260): a, c, t, g, unknown or other
  misc_feature (260)..(260): n is a, c, g, or t
  modified_base (302)..(302): a, c, t, g, unknown or other
  misc_feature (302)..(302): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgctagtcgtggggctggaggtgaggaagccgtggggcctcgagtgaaggttctccgtgcgaaggcttcgnggctacacctcgaccggcgtactatccgtacctacgtgggtnaccgacgaccggccccgttagggaaccgtaagggggtcctttaggacgggtggtaacggttggggtaactcgggaacttaacccgtaaacccccccgtaaacgtaaacggttcggggtaccggaaccctaaaaaacccgtaaaacgttaacgttacgaccctaaaccggtaaacgggtttaaacgggttttaccgggaaaggggggtacctaaaccgggggttacctaacccggtaacggttaccgggaacccggtaaacgggggaaccccgttaaccgggttacccaacgttaccgaacgggtaacccaacgaaccggtaccctaacggtacgttaccgggacgttaccgacggacgtaccgaaaggtcctaggacctaacgtcctaacggaaccgacggtacccggttattaacgtttacttacgttggttacgaagggtacgttaagttttcgggttcggttagggtttccgtttcgggtttttaaccgg

SEQ ID NO: 348858 - DNA, 627 bp, Homo sapiens
  misc_feature: GZ8MTXP01E3O1E.45.37.D04.1.454.CMB.2.raw
  modified_base (495)..(495): a, c, t, g, unknown or other
  misc_feature (495)..(495): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctgagtgaaggtctcctgcaagctctggctacacctcaccggcgactactctccacgtggtgcgacgacggcccctggaacgaagggcgttgaggtggaagtgggactggataccaaaccccctaaacaagtcggtaggaccaaaactaaaactgtacgacaaacgtaggtaaacgtttacggaaggggtacgaacggggttaccaaccgaagtacggaacccgaagggggacccaccggttaccaagacaacgcaacgagtccctaacgntaggagcgtagaggcaacggacctgaacgctcgtcgaacgaccgtaaaccgggcctaatttaacttaacgttgttacggaacgtagggtaagtttcgggtttacgggttcgggttccgttcggtttttccgg

SEQ ID NO: 348859 - DNA, 653 bp, Homo sapiens
  misc_feature: GZ8MTXP01CBEPZ.45.37.D04.1.454.CMB.2.raw
  modified_base (228)..(228): a, c, t, g, unknown or other
  misc_feature (228)..(228): n is a, c, g, or t
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctnagtgaggtctctgcagcttcnggctacncctcaccggcgactatcctccacgtgggtgccgacgacggccccgtggacgaaggggtcttggaggtggagtgggatgggactaccgaaaccccctaacagtgggtaggaccaaacaaactgtacgacaacgaggtaacgtttcgaggggtcgacgggttaccaaccgtagtcggaacccgaacggggtacctaccggtaccaacgtcgacgaccaacgtaccgtacccgtaacgaggttacgggacgtacgtaggacgcgaaacgccgttacgacctacgtcgtaacggaacgttaccgacggttccttaagttttacgttacgttcggttacggtaacgtagggtcgtttacgggtttaccgggttggttaaccgttttcgggtttttaacccgg

SEQ ID NO: 348860 - DNA, 679 bp, Homo sapiens
  misc_feature: GZ8MTXP01BHORO.45.37.D04.1.454.CMB.2.raw
  modified_base (240)..(240): a, c, t, g, unknown or other
  misc_feature (240)..(240): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagacgcccactcccaggtgcagctggtgcaggtcgtggggctggaggtggaggagccgtgggcctgagtgagtctcgngcaggtctcgtggctactcctcgaccggcactactcctaccacgtgggtcgccgacgaccgggccccgtaggaacgagggtcttggaggtgggagtgggtacgtacggtaactacctaaacccgtaacgtaaggtcggtacggaccaaacgtaaaaacttacgtcgacaacgtaaggttaacgttacggacgggacgtacgggtaccacgtagcgaaccggaggacaccgtcacgtacgacgacctaacgacgtacccgtaacggtacggtaggaccgtacgacgaacgaccgaacgtaacgttcggaaacctacgtccgtaacggaacccgtaacgttaccggtaccttaagtttaccgtacgttcgttacgggttacgtaagggttcgtttaacgggtttccggtggtttaccgtttcggtttttcggttaaccggg

SEQ ID NO: 348861 - DNA, 604 bp, Homo sapiens
  misc_feature: GZ8MTXP01A2IHP.45.37.D04.1.454.CMB.2.raw
  modified_base (378)..(378): a, c, t, g, unknown or other
  misc_feature (378)..(378): n is a, c, g, or t
  modified_base (552)..(552): a, c, t, g, unknown or other
  misc_feature (552)..(552): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagacgcccactcccaggtgcagcgtggtgcaggtcgtggggctggaggtgaggagccgtggggcctgagtgaacggtctcgtgacgaggtcttcgtcggactaccaccttcgaccggcgaactactctccgacgtgggtcgcgaccgacggccccgtggaacgtaaggggtcttagggagtgggagttgggatggactaccccaaacctaanaagttcggacgaacaacctaatgcacagtaaggtagtttcgagggcgagggtacacgagtacggacgacgggaccacgtccactgacgacacgacgacctagacgtaggaacgcgtagagacgagtaactacgacacgtcgacgacgaccgttacggtaaccttgttttaacgngttgtaagggcgtaagttcggtcgggtttacgtcgggtttcgttttcccggg

SEQ ID NO: 348862 - DNA, 633 bp, Homo sapiens
  misc_feature: GZ8MTXP01BCLN0.45.37.D04.1.454.CMB.2.raw
  modified_base (238)..(238): a, c, t, g, unknown or other
  misc_feature (238)..(238): n is a, c, g, or t
  modified_base (246)..(246): a, c, t, g, unknown or other
  misc_feature (246)..(246): n is a, c, g, or t
  modified_base (491)..(491): a, c, t, g, unknown or other
  misc_feature (491)..(491): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcgagtcgtggggctggaggtgaggagcgtgggcctgagtgagtctcngcagctgngctacactcgacgcgtactactctcacgtggtcgcgaccgacggcccgtagacgaaggtcgttggaggtgagtggatggactaccgtaacccctaagagtggtacgaccaaaactaaacttgacgactaacgtaaggtagttacggagggtaccgacggtacacgacgtacggaaccggaggaaccacgtaccacgtaccacgacaaccgacgtaccgtacgtaggtggacctaggacgacgganaacgtacgtacgtaaactcgtacgtaaccggaacgttaccgtaaccggttaccttaagtttacgttacgttcggttacggaacgggttacgtcggttttcgggttaccgggttcgttaaccggttttcgggttttaacccgg

SEQ ID NO: 348863 - DNA, 640 bp, Homo sapiens
  misc_feature: GZ8MTXP01CX8JS.45.37.D04.1.454.CMB.2.raw
  modified_base (200)..(200): a, c, t, g, unknown or other
  misc_feature (200)..(200): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (278)..(278): a, c, t, g, unknown or other
  misc_feature (278)..(278): n is a, c, g, or t
  modified_base (287)..(287): a, c, t, g, unknown or other
  misc_feature (287)..(287): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgnggggctggaggtgaggagcgtgggctcagtgagtctcctgcagcttcnggctacnccttcgaccggcactatcctccncgtgggtcnccgacacggccccgtaggaacgaagggtcttggaggtcgggagtgggtagtggaactaccccgaaaccctaaacgaagtcgggtacggaaccaaactaactatagactaacgaacggtaacgtttcgaacgggcgtacgggtaccaacgtcgacgaaccggacgggtaccaccgtaccgtagaccgaacgacaccgaacggggaccctaacgagtacggagtccgtagacgaacgacgtaccgtaggaacctacgtcgaacggaccggtaacgacgtaccctttaagttttacgttacgttggtcgacgggtaaggttcgttcggtttaccgggtcggttcgttttaaccggg

SEQ ID NO: 348864 - DNA, 630 bp, Homo sapiens
  misc_feature: GZ8MTXP01BF8VK.45.37.D04.1.454.CMB.2.raw
  modified_base (189)..(189): a, c, t, g, unknown or other
  misc_feature (189)..(189): n is a, c, g, or t
  modified_base (278)..(278): a, c, t, g, unknown or other
  misc_feature (278)..(278): n is a, c, g, or t
  modified_base (494)..(494): a, c, t, g, unknown or other
  misc_feature (494)..(494): n is a, c, g, or t
  modified_base (517)..(517): a, c, t, g, unknown or other
  misc_feature (517)..(517): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtncagtctggggctgaggtggaggaagccgtggggcctcgagtgaaggtctcctgcgaagtcttctggcctactaccttcaccggcgactntctccacgtggtcgccgacgcggtccccgtggaaccagggtcttaggaggtaggacgtgggacttggactaccgtaaaccctaaaccgtaagtcggtaggaccaacgtaaaacacgtgacaacgtaagttacgttacgacggggtacgacgggtacccacgatccggaacgagggaccacgtccaaagccagacctacactacccagtaggtaggngtacgtacgacgagtacgtaacncgactacgtacgaacgaacccggtaacgttacgtaccttaagttacgtcgttggttcgacggttaacgtacgttaacggttacggtcggtttacgtttcggttttcgtaacgg

SEQ ID NO: 348865 - DNA, 699 bp, Homo sapiens
  misc_feature: GZ8MTXP01A6AF6.45.37.D04.1.454.CMB.2.raw
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (386)..(386): a, c, t, g, unknown or other
  misc_feature (386)..(386): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccgcaagacgcccactcccaggtgcagctggtgcagtcgtggggctggaggtgaaggacgcgtgggcctcgagtgaggtctctgacaggtcttgngctacncctcaccggcgtactatcaccagtggtgcgacgacggccccgtaggaacgaagggtcttggaggtaggtagtgggatacggactaccgaaacccctaagagtgggtacgacctaaaaacaaacgtntggacaagtaacgggttaagttacggaggggtacgtacgggtaccaaccgtaggtaccggaaaccggacgggtaaccaccggttaccacgtacgaaccgaccgtaaacaccggtacctaacgtagtacgggacgtacggacgacgtacgacgtaccgtacgtaacttacgaccgtcgggaaacgacccgtaccgggttacccgtttaaagtttcgttaaccggtttgggacgggtaaccgggtttaggttaacggtttcgggggtttacccgggttcgggtttaaccgttttaacggggtttttttccccggg

SEQ ID NO: 348866 - DNA, 786 bp, Homo sapiens
  misc_feature: GZ8MTXP01AF4ZW.45.37.D04.1.454.CMB.2.raw
  modified_base (259)..(259): a, c, t, g, unknown or other
  misc_feature (259)..(259): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagacgcccactcccgaggtgcagctggtgcagtcgtggggctggaggtgaggagccgtggggcctcgagtgaagtctcgtgacaaggcttcgnggactacaccttcacccggcgaactactcctccgaacgttgggtgccgtacgaccgggccccctagggaaccgtaagggggtcctttagggaaggttagggagttagggggaactttcggggaactaacccccgtaaaacccccgtaaagaaacgttcgggggtacggaaaccaaaaccgtaaaccgttagtaccggaaccgttaaaccgtaaaggggttaaaacggttttccgaaagggggtaccgttaacgggggttaaccctaaaccgaggttaaccgggaaacccggtaaccggggggaaccttaacccggggtacctaacgttccgaaacgttcccgaacgaacggggtaccccttaagaacggtacggaaacgttcgtagacggtacgaacgtaaccgtgaaactcgtaacgtacggaacctacggaaccggttacccttaagttttacccaggttacggtcggtaacggtaacgggttctttacggggttttaccgggtcggtttcccggtttttccggg

SEQ ID NO: 348867 - DNA, 622 bp, Homo sapiens
  misc_feature: GZ8MTXP01B7MY3.45.37.D04.1.454.CMB.2.raw
  modified_base (229)..(229): a, c, t, g, unknown or other
  misc_feature (229)..(229): n is a, c, g, or t
  modified_base (493)..(493): a, c, t, g, unknown or other
  misc_feature (493)..(493): n is a, c, g, or t
  modified_base (508)..(508): a, c, t, g, unknown or other
  misc_feature (508)..(508): n is a, c, g, or t
tcagacgcgatcgacacgaccggtgctcgatttagtagcatactgttgggtttgggggagagcatcacccagcaaccacatctgtcctctagagaatcccctgagagcctccgttcctcaccatggactggacctggaggatcctcttcttggtggcagcagccacaagacgcccacctcccgaggtgcagctggtgcagtcgtgggctgaggtgaggagcgtgggctnagtgacggtctctgacaggtcttcgtggacctacacctcgaccggacgactctctcccgacgtgggcgcgaccgaccggccccgtaggacgagggtctggaggtggagtgggtataggactaaccccgaacctagagtggacgaacaaacgtaatacgtagacgaacgtaggtacgttacggacgggacgtacgggtaccaacgcgtacggaacccgtaggggacccttacggaccagtaccgagtaccaccggacgtctacgnggtagggacgtacgnggacgtacgagtccagtcagtaaccgacggacgtaccgcgtaccttaatttcgttacgcggtaacggaggtaacggttacggttcgggtttacgggtcggtttcgttttccggg

SEQ ID NO: 348868 - DNA, 748 bp, Homo sapiens
  misc_feature: GZ8MTXP01AUCUI.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagcgtggtgcagtcgtggggctggaggtggaggaacgccgtgggggcctcgagtggaaggtctcctgacaaggcttcgtggctactacctcgaccggtcgactactcctccacggtgggtgcgaccgacggtccccgtaggacgtaaggggtcttaggaggtggtagtgggtagtggaactaccaaacccctaacgtaaggtggtacggaccaaaacaaacgtgtacgaccgaacgtaaggtaacgtttcggaacggggtacgaacggggtacaacccggtaagacggaacccggaacgggtaacccgtaccgttaccgtaacaccgaacgtaccaacgacccggtaacctacggtaaacgtagggaccgacgttacggaacggacgaaaccgggtaccttagaacccgtacgtacccgtaagggaaaccccgttaccggtaacccggttacctttaaagttttaacgttaaccggttggttaacggtccgggtaaggttaacggttttaccggggtttaaccccgggttgggttttcccgttttaacgggttttttccccgggg

SEQ ID NO: 348869 - DNA, 685 bp, Homo sapiens
  misc_feature: GZ8MTXP01BS8E0.45.37.D04.1.454.CMB.2.raw
  modified_base (250)..(250): a, c, t, g, unknown or other
  misc_feature (250)..(250): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctcagtgaggtctctgcaggcttcnggctacacctcgaccggcgtactatcctccgacgtgggtcgacgacgacggccccgtaggacgagggtcttaggagtggagtgggattggactaccgaaaccccccgtaacgtaagttggggtacgaccaaaactaaactgtcgacctaacgtaaggttaacggtttacgaggggtaccgtacggggtaccaacccgagtaccggaaccgaggggaaccctacggttacccagtaccgacgaccaaacgacgtacctaacgaggtggacggcgtaggacgcgaacgacgtacgacctacgttccgaacggtaaccgaccggtaaccggttacctttaaagttttaacgttaccgttcggttacggaaccgggtacggtttaacgtttacggggtttacccggggttggtttccggttttcgggtttttaacccgg

SEQ ID NO: 348870 - DNA, 567 bp, Homo sapiens
  misc_feature: GZ8MTXP01ENAUM.45.37.D04.1.454.CMB.2.raw
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (374)..(374): a, c, t, g, unknown or other
  misc_feature (374)..(374): n is a, c, g, or t
  modified_base (430)..(430): a, c, t, g, unknown or other
  misc_feature (430)..(430): n is a, c, g, or t
  modified_base (459)..(459): a, c, t, g, unknown or other
  misc_feature (459)..(459): n is a, c, g, or t
  modified_base (463)..(463): a, c, t, g, unknown or other
  misc_feature (463)..(463): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccaacaagacgcccactccaggtgcagctggtgcagtcgtgggctggaggtgaggaagccgtggggctcgagtgaaggtctcgtgcaggtcttcnggctacncctcacggcactactctccagtggcncgacnggcccctaggaccgagggtctggagtgagtcgggatcggactaccccaacccttaagaagttcggtagaaccaacaagtnacgacagtaagtagttcgagggcgtagggtacacgatcgaacgacggacacgtcanaccgagactacgacggctacgagacgganccgngacgacgacgacgtacactaactgacgacggtacacggttactaacgtttattcgacgtcggaacgtggtacgtacggtttcgggtaacgttcgttttaacggg

SEQ ID NO: 348871 - DNA, 637 bp, Homo sapiens
  misc_feature: GZ8MTXP01BYS4X.45.37.D04.1.454.CMB.2.raw
  modified_base (248)..(248): a, c, t, g, unknown or other
  misc_feature (248)..(248): n is a, c, g, or t
  modified_base (278)..(278): a, c, t, g, unknown or other
  misc_feature (278)..(278): n is a, c, g, or t
  modified_base (364)..(364): a, c, t, g, unknown or other
  misc_feature (364)..(364): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtgggcctcagtgaagtctctgcagctcngctacactcacggcactatctccacgtggngcgacgacggccccgtggacgaagggtctggagtggagtgggatggactaccaaaccccctaagagtggtacggacaaacaaactntgacacgagtagtttacgaggggacacgggtacaaccgagtacgaaccgacgggacaccgtaccacgtcacgaccacgacgaccgtaacgacgtggacgtacgtgaacgacgaaggactacggaacctacgtacgtaacggaaaccgaaccgtaacccgggttactttaaacgttttaacgtttaccgttgggttacgggtaaccgggttaaggtaacggttttacggggtttaccgggttcgggttccgttttcggggttttttaacccggg

SEQ ID NO: 348872 - DNA, 689 bp, Homo sapiens
  misc_feature: GZ8MTXP01AMN2O.45.37.D04.1.454.CMB.2.raw
  modified_base (254)..(254): a, c, t, g, unknown or other
  misc_feature (254)..(254): n is a, c, g, or t
  modified_base (274)..(274): a, c, t, g, unknown or other
  misc_feature (274)..(274): n is a, c, g, or t
  modified_base (276)..(276): a, c, t, g, unknown or other
  misc_feature (276)..(276): n is a, c, g, or t
  modified_base (315)..(315): a, c, t, g, unknown or other
  misc_feature (315)..(315): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagacgcccactcccaggtgcagctggtgcgagtcgtgggctggaggtgaggacgcgtgggctcgagtgagtctcgtgcagtctgtcgctacncctcgaccgcgtactactcncncgtggtcgcgacgcggccccgtggaacgaggtcgtaggnggtaggaggtaggtataggtaactaaccgtaaacccgtaaagtaggtgggtacgaaccaactaaaacgtacgtcgacgaacgtaaggttacgttacgggacggggtacgtaaccgggtaccaacgtaggtaccggaaccgggtacgggaaccctaacccggttaccaagaccgaacgaccaacgtacgtacccaaggggtaacgaggaccgtacggaagacgcgaacgtaacgtactacgtacgttaccgaaggaaacccgtaacgttacccggttaacctttaagtttacgtacgttgggttacgttaacggttggttacggttttaaccggttacgggttgttacgttttaaccggttttcgtttaacgggg

SEQ ID NO: 348873 - DNA, 707 bp, Homo sapiens
  misc_feature: GZ8MTXP01CTZKX.45.37.D04.1.454.CMB.2.raw
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
tcagacgcgatcgacacgaccggtgctcgatttagtagcatactgttgggtttggggagcatcacccagcaaccacatctgtcctctagagaatcccctgagagcctccgttcctcaccatggactggacctggaggatcctcttcttggtggcagcagccacaagacgcccactccccaggtgcagctggtgcaggtcgtggggctggaggtggaggaagccgtgggcctgagtgagtctcngcagtctcnggctacncctcgaccggctactactcctaccgacgtgggtcgaccgacgaccggcccccgtaggaacgaaggggtcgttaggaggtgggagtgggataggactaccgaaaccccgtaacgagtcggtacggacctaaaaactaactgccgacgaaacggtaagtaacgggttcggaacgggggaccgtagggtacccaacgtacgaccggaaaccggaacgggtacctaacggtaccaacgtaccgacgaccaacgaccgaccgttaacgaggtacggacgtacgaggaccgacgaacgtacgtagacgtactcggtaaccgaaccgaccggtaaacccgttccgtttaaagtttacgttaccgttaggttcgggtaacccgggttaggttaaccggtttaccgggttttacccggggttggttttcccgggttttccgggttttttaacccggg

SEQ ID NO: 348874 - DNA, 658 bp, Homo sapiens
  misc_feature: GZ8MTXP01CR22I.45.37.D04.1.454.CMB.2.raw
  modified_base (346)..(346): a, c, t, g, unknown or other
  misc_feature (346)..(346): n is a, c, g, or t
  modified_base (532)..(532): a, c, t, g, unknown or other
  misc_feature (532)..(532): n is a, c, g, or t
  modified_base (603)..(603): a, c, t, g, unknown or other
  misc_feature (603)..(603): n is a, c, g, or t
tcagacgcgatcgacacgaccggtgctcgattttagtagcatactgttgggtttgggggagagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaacgccgtggggcctgagtagaacggtctcctgacgaaggtcttcgtggactacaccttcgaccggcgtaactactctccgacgttgggacgcgacgacggcccctaggaacgaagggtctagggagnggtagaggtagcggtaactaccccaaaccgtaaacgagtcggaggaaaccaataaactgtacgactaacggaaggtaagtttacggagggtaccgtagggtacccaacgtagtacggaccgaaggggaacctacgtaccaacgtacgaaggacctaacgaacggtaccctaagttacggacggaanccgagggaacacctaagacctagaacctagttcgaacgacgtaacgacggttacttaactttaacgttcgnggttaacgagggtaagtaacgttcgggttaacggttcggttgtttttaacccggg

SEQ ID NO: 348875 - DNA, 728 bp, Homo sapiens
  misc_feature: GZ8MTXP01CAVI9.45.37.D04.1.454.CMB.2.raw
  modified_base (557)..(557): a, c, t, g, unknown or other
  misc_feature (557)..(557): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtcgccgtacggggacatcgtgatcgacccagtcctccacgacctcccgtcggccgtcgtctcgtgggcgacggacgggccaccatacaactgaccaacgtaccacgaccagtagttagtttacgacacgtacctaccaaacaaataacgaaacttactagcttacggacacgacaacgaaaccgaggtacacgcctacctaacgtctcgtccttactacgtttcggacggactacgtaccggtacccgggtaccgtcccggggtccgtaccgaccgtagtacgtagtcggaacgtacggtcgggtacgtacgggactacggtcttaccgtcctacgacccacgtatacgacgtcgaccgtcgttcgaagccggtagtaacggaagtggtcggtacgggtaactttaggtttactcggttntacgtacgtataacttaattaactttacttaccgttacccgtttccccggttaccgtttaaccggtacccggttaaccggttaaaccgggtaaacgttaaacggttacgttaaaccttaaaccgtaaccgtaaacggtcgttacgggttacgtaacccgttaacgtaaccc

SEQ ID NO: 348876 - DNA, 703 bp, Homo sapiens
  misc_feature: GZ8MTXP01AGG5S.45.37.D04.1.454.CMB.2.raw
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccaacaagacgcccactccccaggtgcagctggtgcagtcgtggggctggaggtgaggagccgtggggcctcgagtgaggtctctgacagtctcnggctacncctcgaccggcgtactatccgtaccagtggtcgcgacgaccggccccgtaggacgtaagggtcttaggaggtggagtcgggagtcgtactaccaaacccctaagagtcggtacgacctaaaacaaacgtgtcgaacgtaacgtaaacgggtaacgtttacggaacggggtaccgtacggggtaccaaccgtaacgtaccgggaaacccggaacggggaacccgtaaccgtaccgtaaacgaccgaaaccggaccctaaccgaacggtaacccgttaacggaacgggttacgggaaccggtacgtacggaacggaccgtaacggaccgtacgaacctacgtccggaacggaacccgacgtaaccggttacttaagtttaacgttcgttgttcggaacgtaggttaacgttcggttacgggttgttcggtttcggttttaaccgg

SEQ ID NO: 348877 - DNA, 639 bp, Homo sapiens
  misc_feature: GZ8MTXP01AIH5H.45.37.D04.1.454.CMB.2.raw
  modified_base (381)..(381): a, c, t, g, unknown or other
  misc_feature (381)..(381): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgagggtgaggaagccgtggggcctcagtgaaggtctcctgcaggcttctggctactacctcaccggcgactatcctccacgtgggtcgcgacacggcccccgtggacaaggggtcttgaggtggagtgggatgggactaccaaaccccctaacaagtgggtacgacaaaccaaactntcgactaacgagtaagtttccgagggacgagggtacaaccgagtacgaaccgagggaaccacgtacctagtaccaagcacgacgaccctagaagtcggaacgctaggacgacgaacgtactacgaactacgtacgtaacggaaccgaaccgaccgggttacccttaaagttttacttaaccgttggttacggccggtagggtaacgtttacggggttttaccgggttcggttaaccggttttcgggtttttaaccccg

SEQ ID NO: 348878 - DNA, 653 bp, Homo sapiens
  misc_feature: GZ8MTXP01DIN49.45.37.D04.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (272)..(272): a, c, t, g, unknown or other
  misc_feature (272)..(272): n is a, c, g, or t
  modified_base (356)..(356): a, c, t, g, unknown or other
  misc_feature (356)..(356): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtgggcctnagtgagtctctgacagcttnggctacactcncgcactatctcagtggngcgacgacgcccgtggaaccgaggtcttggaggtaggagtgggataggtactacaaaccctaagagtggtgacaactaaaactntcgacacgtaaagtacgtttcggacggggtcgacgggttaccaacgtaacgtacggaaccgacggggaaccctaccgtacgaactaccggaacgaaccaacgtaaccgtaccctaagggacggttacggggaaacgtccgtaaggacggtacgacggtaaccgtaaacgtaacgtacgtaccggaacgaaccgaaccgttacgttacttaagtttacgtcggttagttcggttaacggtaacggttacgtttccgggttcgggtcggtttccgttttcggtttaaccgtttaacggg

SEQ ID NO: 348879 - DNA, 576 bp, Homo sapiens
  misc_feature: GZ8MTXP01D5GLJ.45.37.D04.1.454.CMB.2.raw
  modified_base (184)..(184): a, c, t, g, unknown or other
  misc_feature (184)..(184): n is a, c, g, or t
  modified_base (228)..(228): a, c, t, g, unknown or other
  misc_feature (228)..(228): n is a, c, g, or t
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
  modified_base (360)..(360): a, c, t, g, unknown or other
  misc_feature (360)..(360): n is a, c, g, or t
  modified_base (491)..(491): a, c, t, g, unknown or other
  misc_feature (491)..(491): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtncagctggtgcagtcgtgggctggaggtgaggagccgtgggcctnagtgaaggtctcctgacgaggtcttcgnggctacnccttcgaccggcgactagtcctccgacgtgggtcgacgacgacggccccctaggaacgaagggtcttggaggtggagtggatggatacccaacctanaagtggacgaacaacaacgtatacgacacgaagtagttcgagggacaggtacacgagtacgacgacggacacgtcagcacgcacgagacctagtacgtagacgtcagacgacacgtacgagtacagtaacncgaacgacgttacgtaccttaatttaagttcgttaggttcgaggtaacggttagttcgggtttacggtcggttcgtttttccggg

SEQ ID NO: 348880 - DNA, 619 bp, Homo sapiens
  misc_feature: GZ8MTXP01BA2LZ.45.37.D04.1.454.CMB.2.raw
  modified_base (225)..(225): a, c, t, g, unknown or other
  misc_feature (225)..(225): n is a, c, g, or t
  modified_base (236)..(236): a, c, t, g, unknown or other
  misc_feature (236)..(236): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
  modified_base (266)..(266): a, c, t, g, unknown or other
  misc_feature (266)..(266): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (329)..(329): a, c, t, g, unknown or other
  misc_feature (329)..(329): n is a, c, g, or t
  modified_base (432)..(432): a, c, t, g, unknown or other
  misc_feature (432)..(432): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccacctcccaggtgcagctggtgcagtctggggctgaggtgaggagcctgggctnagtgagtctcngnagctcngctacnctcacggngactatcncatggtncgacncggccctaggacaaggtctgacgtggagtggatggatacaaaccccctaanaagtggcgacaaaacaaaatgtcgacgaataagtaaacgttcgaagggggacagggttaccaacgtagacgaaaccgaagggaccaacgtaccagaccgaaanacgaacgacgaccgtacgtagacggacgacgtacggacgacgaaacgaacgtacgtaacgtactaccgtaacgtaacgaaacccgtaaccgttaaccgttaaacgtttaacgttagttacggttacggtaacgggtaggttaacggtttacgggtttaccggttacggttcggtttcggttttaacg

SEQ ID NO: 348881 - DNA, 617 bp, Homo sapiens
  misc_feature: GZ8MTXP01DQIT7.45.37.D04.1.454.CMB.2.raw
  modified_base (562)..(562): a, c, t, g, unknown or other
  misc_feature (562)..(562): n is a, c, g, or t
tcagacgcgatcgacacgaccggtgctcgatttagtagcatactgttggggtttggggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctgggggcctcagtgaaggtctcctgcaagggcttctggctacacctcaccggcgactagtctccactgggtgcgacgaggccccctgggacaagggggcctttgagttggatcggggatggatcaaaccccccttaacaaagtcggtggacgaaacctaaaccgtaatcgggtcacgacgtaaagttttccgagggacgtacgggtacgaccctagtagacccgaggggaaacttaaccggccctaaatccaagcaaccacggttaccgaactactaggggagcgttcggaggaccaggttaacctggaacctaatctaaggacacgacgggcccaattttanacgtttgttaggcgaggttctgttttacgggttcggtccttaagggggttttccc

SEQ ID NO: 348882 - DNA, 910 bp, Homo sapiens
  misc_feature: GZ8MTXP01BE8XE.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagcgtggtgcgagtcgtggggctggaggtgaggaacgccggtggggcctcgagtgaaggttcctccgtgacgaggtcttcgtggcctacctccgtccgaccggcgtactagtcctacctacggtgggtcgaccgtaccgaccggtccccgtaggaacggtaacggggtctttagggacgggttaggggtacggtaggggtaacgttacggtaaacgttaccccgtaaaaacccccccgtaaagtaaacgggttcggggtaacgggaaaccctaaaaaaccctaaaacgttaacgtaccgtaaaccgtaaacccggtaaacgggttaaacggttttaccggggaaacgggggttaccggtaaccgggggtaaacctaaccccggttaaggtaacccgggaaacccgggtaacggggaaacccgtaaccccgttaccgaaacgttaccgaacgaaccccaacgtaacccgggtaccctaaaccgttaagggtacgggtaaccgccggttaaacgggacacccggtaaaacggttcccgtaacggaaccttacgttaccggaaccgggttaacgaaccccggttaaccgggttaaccctttaaaggtttacggtttaaccgttggggttaacggtaaccgggggttaaaacgggttccggtttttaaaccgggggttaccggggttaccggttttccgggtttttcccggggtttttttaaccccgggg

SEQ ID NO: 348883 - DNA, 661 bp, Homo sapiens
  misc_feature: GZ8MTXP01BHJGO.45.37.D04.1.454.CMB.2.raw
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtgggcctgagtgaagtctctgcaggcttnggctacnctcaccggcactatcctccacgtgggtcgaccgacgaccggcccccgtggaacgaaggggtctttggaggtggagtcggggatggactaccgaaacccccctaagaagtgggtacgaccaaaacaaactgtacggacaaacgtaaggtaacgtttcggaagggtcacgggtacaccgtagcgaaccgagggaacctacgtaccaagcgacgcaacgtacgaccccttaagaggttacgggacgcgtaaggacgaccgtaaggtaccctaggactaacgttcgaacggaaccgttaccgtacccggttaccttaaagttttaacgttaccgttggttcggaacggtcgggtaagttttcggggttaacccgggttcgttcccggttttccgggttttttaacccgg

SEQ ID NO: 348884 - DNA, 691 bp, Homo sapiens
  misc_feature: GZ8MTXP01AC3N5.45.37.D04.1.454.CMB.2.raw
  modified_base (410)..(410): a, c, t, g, unknown or other
  misc_feature (410)..(410): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgacccagtcctccagacctcccgtggctgtcgtcgtcgtgggcgaggacggccaccatacaactgacacgtccagaccaggtacgttagtttacacgacgtacctacaaactaagtaaacgtaaccttacgtagtacgttacggtaaccacgacgaaacgaaaccgacgtacaccgtcctacgagtctgactactacttacgcgactacgtaccggtaccggtacgtcccggtacctcgacgtcgtacgngacgacgtcggcggtacgagacgtagtctacacctacgtacacccaagtcgacgtacgactccggtagtacgagtaccgtaagacgttaggtcggggtagttaccgttagtttacgtcgtaacgttcgacttaagaacgtttatttaaatttcgtttaaaccggttcttaaccccggtttacggttaacccggtttacccgggaccgtttaaaccgggttaaacgttacggttacgtaactaccgtaaacgtaaaccgtcggttagtcgttaacgttaacc

SEQ ID NO: 348885 - DNA, 599 bp, Homo sapiens
  misc_feature: GZ8MTXP01DJ8G0.45.37.D04.1.454.CMB.2.raw
  modified_base (281)..(281): a, c, t, g, unknown or other
  misc_feature (281)..(281): n is a, c, g, or t
  modified_base (464)..(464): a, c, t, g, unknown or other
  misc_feature (464)..(464): n is a, c, g, or t
  modified_base (482)..(482): a, c, t, g, unknown or other
  misc_feature (482)..(482): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggggctggaggtgaggaacgccgtggggccttcagtgaaggtctcctgccaaggcttcgtggctacactcaccggcgactanctccactgggtgcgacacggccccgtggaacaagggcttgacgtggagttcgggatgggataccaaaccccctaagtaatgggtggacaaaacaaacttgtcgacaacgaagtaacgtttcgaaggggcagggtcaccgatcgaaccgagggacaccggtacacgtcagctaacagtcctaanagtcggaactcgagcganaacggctggacctagtactcggaaaccgctaccgggacctttaaagttttacttaacgttcgttaggaaccgaggtcgtttacggttaccgggttggtcgtttcggtttttaacccg

SEQ ID NO: 348886 - DNA, 496 bp, Homo sapiens
  misc_feature: GZ8MTXP02I3OFG.45.37.D04.1.454.CMB.2.raw
  modified_base (288)..(288): a, c, t, g, unknown or other
  misc_feature (288)..(288): n is a, c, g, or t
  modified_base (470)..(470): a, c, t, g, unknown or other
  misc_feature (470)..(470): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtncgacaggcccctggacaagggcttgagtggatgggatggatccaacctacaatggtgcacactatgacacagaagtttcagggcagggtcaccatgacagggacacgtccaatcagcacacgctacatggaagctgagacagactgacatctagacgacacggcctatttacttactgtcgngaggatggttaccggtggtctttcgg

SEQ ID NO: 348887 - DNA, 549 bp, Homo sapiens
  misc_feature: GZ8MTXP02I8Z97.45.37.D04.1.454.CMB.2.raw
tcagacgcgatcgacacgaccggtgctcgatttagtagcatactgttgggtttggggcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggagccgtgggggcctcagtgaaggtctcctgcaaggcttctggctacaccttcaccggcgactatctccactggggtgcgacaggccccctggacaaggggcttggagtggatggggatggatacaaaccctaacaagtgggtaggacaacaaaactatggacaacaagtaagtttcgaaggggcagggtccaaccgatcgacagggacacgtccagtcagacacacgcctacagtggagctagagctaagactgacatcagacacgacggacctaatttactacgtcgtagacgaaggtacttcggtttaccggtggtcctttcggtttcttttacggg

SEQ ID NO: 348888 - DNA, 502 bp, Homo sapiens
  misc_feature: GZ8MTXP02JUGJF.45.37.D04.1.454.CMB.2.raw
  modified_base (359)..(359): a, c, t, g, unknown or other
  misc_feature (359)..(359): n is a, c, g, or t
tcagacgcgatcgacacgaccggtgctcgatttagtagcatactgttgggtttggggagcatcacccagcaaccacatctgtcctctagagaatccccctgagagctccgttcctcaccatggactggacctggaggatcctcttcttggtggcagcagccacaagagcccactcccaggtgcagctggtgcagtctgggggctgaggtgaggaagcctgggggcctcagtgaaggtctcctgcaaggcttctggctacaccttcaccggcgactatctccactgggtgcgacaggccccctggacaagggcttgagtggatgggatggatcaaccccctaacaatggtggcacaactntgcacagaagttcagggcagggtcaccgatgaccaggggacacgtccatcagcacagacctacatggagctgagcagactgacatctgacgacacggccatttactactgtagcgaggatcgttaccggtgtcgtggtttccg

SEQ ID NO: 348889 - DNA, 502 bp, Homo sapiens
  misc_feature: GZ8MTXP02IYHNL.45.37.D04.1.454.CMB.2.raw
  modified_base (357)..(357): a, c, t, g, unknown or other
  misc_feature (357)..(357): n is a, c, g, or t
  modified_base (484)..(484): a, c, t, g, unknown or other
  misc_feature (484)..(484): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctctaagctgctcatttactggcatctacccgggaatccggggtcccctgaccgattcagtggcnggcgggtctggggacagatttcactctcaccatcagcagcctgcaggctagaaagatggtgtctagtttatgctgtcagctaatattatatacttctccgtacttcggcctggaaccaagtgaatanacaaacgactgtcgctcg

SEQ ID NO: 348890 - DNA, 494 bp, Homo sapiens
  misc_feature: GZ8MTXP02GY7U3.45.37.D04.1.454.CMB.2.raw
  modified_base (355)..(355): a, c, t, g, unknown or other
  misc_feature (355)..(355): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacaccttcaccggcgactatctccactgggtgcgacaggcccctggacaagggcttgagtggatgggatggatcaaccccctacaatggtggcacaaactntgcatagaagtttcagggcagggtcaccatgaccagggacacgtcagtcagcacagcctacatggagctgagcagactgacatctgacacacggccatttactactgtgcgagactgttaccggtgtcttcggtttccg

SEQ ID NO: 348891 - DNA, 494 bp, Homo sapiens
  misc_feature: GZ8MTXP02HWQXC.45.37.D04.1.454.CMB.2.raw
  modified_base (311)..(311): a, c, t, g, unknown or other
  misc_feature (311)..(311): n is a, c, g, or t
  modified_base (344)..(344): a, c, t, g, unknown or other
  misc_feature (344)..(344): n is a, c, g, or t
  modified_base (354)..(354): a, c, t, g, unknown or other
  misc_feature (354)..(354): n is a, c, g, or t
tcagacgcgatcgacacgaccggtgctcgatttagtagcatactgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctctaagctgctcatttacnggcatctaccggaatccggggtcccctgaccgnttcagtggcngcgggtctgggacagatttcactctcaccatcagcagcctgcaggctgaagatgtggctagtttatgctgtcagcaatattatatacttctcactttcgcctggaccaaagtcgaatatacaaacgaactcgagtctacg

SEQ ID NO: 348892 - DNA, 519 bp, Homo sapiens
  misc_feature: GZ8MTXP02I5WXP.45.37.D04.1.454.CMB.2.raw
  modified_base (425)..(425): a, c, t, g, unknown or other
  misc_feature (425)..(425): n is a, c, g, or t
  modified_base (500)..(500): a, c, t, g, unknown or other
  misc_feature (500)..(500): n is a, c, g, or t
tcagacgcgatcgacacgaccggtgctcgatttagtagcatactgttgggtttgggggcatcaccccagcaaccacatctgtcctctagagaatccccctgagagctccgttcctcaccatggactggacctggaggatcctcttcttggtggcagcagccacaagagccccactccccaggtgcagctggtgcagtctgggggctgaggtgaggaagcctgggggcctcagtgaaggtctcctgcaaggcttctggctacaccttcaccggcgactatctccactggggtgcgacaggccccctggacaaggggcttgagtggatggggatggatcaacccctaaccaatggtggcacaaaactatgcacagagtttcagggcagggtcacatgaccagggacacgtccatcagcacagcctanactggagctagagcagactagacatctgacgacaccggctatttactactgtgcgaaggtacgtggtttaccggngtcgtcggtttcttttcgg

SEQ ID NO: 348893 - DNA, 498 bp, Homo sapiens
  misc_feature: GZ8MTXP02G7JPX.45.37.D04.1.454.CMB.2.raw
  modified_base (352)..(352): a, c, t, g, unknown or other
  misc_feature (352)..(352): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactactagcttggtaccagcagaaaccaggtcagcctcctaagctgctcatttactggcatctaccggaatccgggtcccctgaccgatcagtgcngcggtctgggacagatttcactctcaccatcagcagcctgcaggctgaaagatgtggcagtttattgctgtcagctaatattattatattcctcgtactttcggcctgggaaccaaagtgaatatacaaacgaactcgtggactcg

SEQ ID NO: 348894 - DNA, 504 bp, Homo sapiens
  misc_feature: GZ8MTXP02GH4FI.45.37.D04.1.454.CMB.2.raw
  modified_base (357)..(357): a, c, t, g, unknown or other
  misc_feature (357)..(357): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctgggggcctcagtgaaggtctcctgcaaggcttctggctacaccttcaccggcgactatctccactgggtgcgacaggccccctgaacaagggcttgagtggatgggatggatcaaccccctacaatggtgcacaaactntgcacagaagtttcaggggcagggtcaccatgaccaggggacacgtcatcagcacagcctacatggagctgagcagactgacatctagacgacacggcctatttactactgtgcgaggattcggttaccggtggtcttggttttccg

SEQ ID NO: 348895 - DNA, 491 bp, Homo sapiens
  misc_feature: GZ8MTXP02IUPC7.45.37.D04.1.454.CMB.2.raw
  modified_base (359)..(359): a, c, t, g, unknown or other
  misc_feature (359)..(359): n is a, c, g, or t
  modified_base (429)..(429): a, c, t, g, unknown or other
  misc_feature (429)..(429): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctgggggcctcagtgaaggtctcctgcaaggcttctggctacaccttcaccggcgactatctccactgggtgcgacaggccccctggacaagggcttgagtggatgggatggatcaaccccctaacaatggtggcacaaactntgcacagaagtttcagggcagggtcaccatgaccagggacacgtcatcagcacagcctacatgagctgancagactgacatctgacgacacggccatttactactgtgcgagatgttacggtgctgtttccg

SEQ ID NO: 348896 - DNA, 497 bp, Homo sapiens
  misc_feature: GZ8MTXP02JEHH1.45.37.D04.1.454.CMB.2.raw
  modified_base (357)..(357): a, c, t, g, unknown or other
  misc_feature (357)..(357): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
  modified_base (494)..(494): a, c, t, g, unknown or other
  misc_feature (494)..(494): n is a, c, g, or t
tcagacgcgatcgacacgaccggtgctcgatttagtagcatactgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtaccagcagaaaccaggtcagcctcctaagctgctcatttactggcatctacccgggaatccggggtccccctgaccgattcagtggcngcgggtctggggacagtatttcactctcaccatcagcagcctgcaggctgaanatgnggctagtttatgctgtcagcaatatatatacttcctcgtacttcgccctggaccaagtgaatactacaaacgactgtcgntcg

SEQ ID NO: 348897 - DNA, 647 bp, Homo sapiens
  misc_feature: GZ8MTXP02H4AHS.45.37.D04.1.454.CMB.2.raw
  modified_base (227)..(227): a, c, t, g, unknown or other
  misc_feature (227)..(227): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
  modified_base (339)..(339): a, c, t, g, unknown or other
  misc_feature (339)..(339): n is a, c, g, or t
tcagacgcgatcgacacgaccggtgctcgatttagtagcatactgttgggtttggggagcatcacccagcaaccacatctgtcctctagagaatccccctgagagctccgttcctcaccatggactggacctggaggatcctcttcttggtggcagcagccacaagagcccactccccaggtgcagctggtgcagtctggggctgaggtgaggaagcctggggcctnagtgaaggtctcctgcaaggcttctggctacaccttcaccggcgactatctccactgggtncgacnggcccctggacaggctgagtggatgggatggatacaaccccctaanaagtggtaggtacaacgtaaacctatcggacaaccgtagtaaagtttcgaagggtcaaggggtaccaaccgaacgttcgaacccgaacggggtacctaacggtcctaaacgtccgagtaccgaacgacggtacctaacgtagttacgggaacgtaccgttagaacgaccgtaaacggtaccttacggactacgtacgttcggaaaaccgtacgaaccggtacctaaacgttttaacgttaccgttagtacgtaaccggtaaggtaacgttacggtttaaccggttcggtacgtttcggttttacccgg

SEQ ID NO: 348898 - DNA, 507 bp, Homo sapiens
  misc_feature: GZ8MTXP02GNKJ0.45.37.D04.1.454.CMB.2.raw
  modified_base (359)..(359): a, c, t, g, unknown or other
  misc_feature (359)..(359): n is a, c, g, or t
  modified_base (416)..(416): a, c, t, g, unknown or other
  misc_feature (416)..(416): n is a, c, g, or t
tcagacgcgatcgacacgaccggtgctcgatttagtagcatactgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctctaagctgctcatttactgggcatctacccggggaatccggggtccccctgaccgattcagtggcngcgggtctgggacagatttcactctcaccatcagcagccctgcaggctagaagatgnggctagtttatgctgtcagcaatattattatattcctcgtactttcggcctcgggaccaagtggaatactacaaacgactgtacggctacg

SEQ ID NO: 348899 - DNA, 498 bp, Homo sapiens
  misc_feature: GZ8MTXP02HDRSC.45.37.D04.1.454.CMB.2.raw
  modified_base (288)..(288): a, c, t, g, unknown or other
  misc_feature (288)..(288): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtncgacaggcccctggacaagggcttgagtggatgggatggatccaaccctaacaatggtggcaacaactatgacacagaagtttcagggcagggtcacatgacaggacacgtcatcancacngctacatggagctgagcagactgacatctagacgacacggacctatttactaactgtgtcgaggtatgtttaccggtcggtcgtttcgg

SEQ ID NO: 348900 - DNA, 570 bp, Homo sapiens
  misc_feature: GZ8MTXP02HCNXP.45.37.D04.1.454.CMB.2.raw
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (411)..(411): a, c, t, g, unknown or other
  misc_feature (411)..(411): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctcaacaataagaactacttagctggtaccagcagaaaccaggtcagcctcctaagctgctcatttactggcatctaccggaatccggggtcccctgaccgntcagtgcngcggtcngggacngtattcactctcaccatcagctagccctgacgacggactggaaaagnttggtcggagtaggttttaattcggcttcggttacacgtacttaaattatttaattaacttacttcccgttacccgttaccgtttccggacccgttacgggtaaaccgtaaaggttacggtaacttaacgtaacgaaaacgtacgtggtacggactacg

SEQ ID NO: 348901 - DNA, 506 bp, Homo sapiens
  misc_feature: GZ8MTXP02JTB4H.45.37.D04.1.454.CMB.2.raw
  modified_base (358)..(358): a, c, t, g, unknown or other
  misc_feature (358)..(358): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctgggggcctcagtgaaggtctcctgcaaggcttctggctacaccttcaccggcgactatctccactgggtgcgacaggcccctggacaagggcttgagtggatgggatggatcaacccccgtacaatggtggcacaaactntgacacagaagtttcagggcagggtcaccatgaccagggacacgtccatcagcacagcctacatggagctgagcagacagacaatctcgacgacacggcctacttattactgtgcgaggagtacgttacggtcggtcgtcgttttccg

SEQ ID NO: 348902 - DNA, 496 bp, Homo sapiens
  misc_feature: GZ8MTXP02I3U2C.45.37.D04.1.454.CMB.2.raw
  modified_base (354)..(354): a, c, t, g, unknown or other
  misc_feature (354)..(354): n is a, c, g, or t
  modified_base (384)..(384): a, c, t, g, unknown or other
  misc_feature (384)..(384): n is a, c, g, or t
  modified_base (409)..(409): a, c, t, g, unknown or other
  misc_feature (409)..(409): n is a, c, g, or t
tcagacgcgatcgacacgaccggtgctcgatttagtagcatactgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgtttagacagctccaacaataagaactacttagcttggtaccagcagaaaccaggtcagcctcctaagctgctcatttactggcatctacccggaatccggggtcccctgaccgattcagtggcnggcgggtctgggacagatttcactctcacntcagcagcctgcaggctgaagatgnggcagtttatgctgtcagcaatattatatacttcctcgtactttcggccttcggaccaagtgaatatacaaacgactgtcggactcg

SEQ ID NO: 348903 - DNA, 550 bp, Homo sapiens
  misc_feature: GZ8MTXP02H3AG8.45.37.D04.1.454.CMB.2.raw
  modified_base (363)..(363): a, c, t, g, unknown or other
  misc_feature (363)..(363): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctggggcctcagtgaaggtctcctgcaaggcttctggctacaccttcaccggcgactatctccactgggtgcgacacggcccctggacaagggcttgagtggagtgggatggatcaaccccctaacaagtggtaggcaacgaaactntgacacagtaagttcgagggtcaggggtacaccgagtcgaccgagggacacgtccacgtcacgcacacgacctacgagtcggagcgtagagacagctagactacgttcacgacgacacggaccttatttactacgttgtgtaacggaggtaacttcggttaccggtcggtcgtttacggtttttccg

SEQ ID NO: 348904 - DNA, 502 bp, Homo sapiens
  misc_feature: GZ8MTXP02IB29I.45.37.D04.1.454.CMB.2.raw
  modified_base (422)..(422): a, c, t, g, unknown or other
  misc_feature (422)..(422): n is a, c, g, or t
  modified_base (446)..(446): a, c, t, g, unknown or other
  misc_feature (446)..(446): n is a, c, g, or t
tcagacgcgatcgacacgaccggtgctcgatttagtagcatactgttgggtttggggagcatcacccagcaaccacatctgtcctctagagaatccccctgagagctccgttcctcaccatggactggacctggaggatcctcttcttggtggcagcagccacaagagcccactcccaggtgcagctggtgcagtctgggggctgaggtgaggaagcctgggggcctcagtgaaggtctcctgcaaggcttctggctacaccttcaccggcgactatctccactgggtgcgacaggccccctggacaagggcttgagtggatgggatggatcaaacccctaacaaatggtggcacaaactatgacacagaagtttcagggcagggtcacatgacagggacacgtccaatcagcacagcctanatgagctgagcagctagacattcngacgacacggccaattattactgtgcgaggattcgttaccggtggcttggtttccg

SEQ ID NO: 348905 - DNA, 496 bp, Homo sapiens
  misc_feature: GZ8MTXP02IVMVP.45.37.D04.1.454.CMB.2.raw
  modified_base (359)..(359): a, c, t, g, unknown or other
  misc_feature (359)..(359): n is a, c, g, or t
  modified_base (390)..(390): a, c, t, g, unknown or other
  misc_feature (390)..(390): n is a, c, g, or t
  modified_base (406)..(406): a, c, t, g, unknown or other
  misc_feature (406)..(406): n is a, c, g, or t
  modified_base (415)..(415): a, c, t, g, unknown or other
  misc_feature (415)..(415): n is a, c, g, or t
  modified_base (426)..(426): a, c, t, g, unknown or other
  misc_feature (426)..(426): n is a, c, g, or t
  modified_base (433)..(433): a, c, t, g, unknown or other
  misc_feature (433)..(433): n is a, c, g, or t
  modified_base (436)..(436): a, c, t, g, unknown or other
  misc_feature (436)..(436): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaccaggtcagcctcctaagctgctcatttactgggcactctacccgggaatccggggtcccctgaccgattcagtggcnggcggtctgggacagtatttcactctcaccntcagcagcctgcagcngaagatggnggctagtttangctgtcnganatatattatatctctacttcgtcgtcgactaagtagaagtatacaacactacgtgcgtcg

SEQ ID NO: 348906 - DNA, 521 bp, Homo sapiens
  misc_feature: GZ8MTXP02FVU0P.45.37.D04.1.454.CMB.2.raw
  modified_base (355)..(355): a, c, t, g, unknown or other
  misc_feature (355)..(355): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctcaacaataagaactactagcttggtaccagcagaaaccaggtcagcctctaagctgctcatttactggcatcctaccgggaatccggggtccccctgaccgattcagtggcnggcgggtctgggacagatttcactctcaccatcagcagccctgcaggctagaagatgtggtctagtttatgctgtcagacaatatttattattacttcctaccgtactttcggaccctcgggaaccaaaggttaggaatactacaaaacgtactcggtaggctacg

SEQ ID NO: 348907 - DNA, 504 bp, Homo sapiens
  misc_feature: GZ8MTXP02HDB68.45.37.D04.1.454.CMB.2.raw
  modified_base (421)..(421): a, c, t, g, unknown or other
  misc_feature (421)..(421): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatgggatggatccaacctaacaatggtggcacaactatgcacagaagtttcgagggcagggtcacatgacaggacacgtccatcagcacagcctacatgganctgagcagactgacatcagacgacacggcctatttacttaacgtgttgacgacggtattggtttaacccggtggtctttcggg

SEQ ID NO: 348908 - DNA, 517 bp, Homo sapiens
  misc_feature: GZ8MTXP02GKP91.45.37.D04.1.454.CMB.2.raw
  modified_base (360)..(360): a, c, t, g, unknown or other
  misc_feature (360)..(360): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctgaggtgaggaagcctgggggcctcagtgaaggtctcctgcaaggcttctggctacaccttcaccggcgactatctccactgggtgcgacaggccccctggacaagggcttgagtggatgggatggatcaaccccctaacaatggtggcacaaactntgcacagaagttcagggcagggtcaccatgacagggacacgtcatcagcacagacctacatggagttgagcagactgacatctagacgacacggacctagtttacttactcgtagtcgaaggtatggtttaccggtggtcttggtttcccttttagg

SEQ ID NO: 348909 - DNA, 506 bp, Homo sapiens
  misc_feature: GZ8MTXP02IAWYR.45.37.D04.1.454.CMB.2.raw
  modified_base (360)..(360): a, c, t, g, unknown or other
  misc_feature (360)..(360): n is a, c, g, or t
  modified_base (492)..(492): a, c, t, g, unknown or other
  misc_feature (492)..(492): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactccccaggtgcagctggtgcagtctggggctgaggtgaggaagcctggggcctcagtgaaggtctcctgcaaggcttctggctacaccttcaccggcgactatctccactgggtgcgacaggccccctggacaagggcttgagtggatgggatggatcaaccccctaacaatggtggcacaaactntgcacagaagtttcagggcagggtcaccatcgacgaggacacgtccatcagcacagcctacatggagctgagcagactgacatctcgacgacacggcctagtttactactgtgcgagtacgtgtttaccggngtcgttggtttccg

SEQ ID NO: 348910 - DNA, 509 bp, Homo sapiens
  misc_feature: GZ8MTXP02JUD44.45.37.D04.1.454.CMB.2.raw
  modified_base (356)..(356): a, c, t, g, unknown or other
  misc_feature (356)..(356): n is a, c, g, or t
  modified_base (426)..(426): a, c, t, g, unknown or other
  misc_feature (426)..(426): n is a, c, g, or t
  modified_base (494)..(494): a, c, t, g, unknown or other
  misc_feature (494)..(494): n is a, c, g, or t
tcagacgcgatcgacacgaccggtgctcgatttagtagcatactgttgggtttggggagcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggaagcctgggggcctcagtgaaggtctcctgcaaggcttctggctacaccttcaccggcgactatctccactgggtgcgacaggcccctggacaagggcttgagtggatgggatggatcaacccctacaatggtggcacaaactntgacacagaagtttcagggtcagggtcaccatgaccagggacacgtcatcagcacagcctacagtgagcngagcagactgacatctgacgacacggcctaagtttactacgtgtgaacgaggtacttcggttaccggnggtcgtggttttccg

SEQ ID NO: 348911 - DNA, 493 bp, Homo sapiens
  misc_feature: GZ8MTXP02GE56R.45.37.D04.1.454.CMB.2.raw
  modified_base (308)..(308): a, c, t, g, unknown or other
  misc_feature (308)..(308): n is a, c, g, or t
  modified_base (348)..(348): a, c, t, g, unknown or other
  misc_feature (348)..(348): n is a, c, g, or t
tcagacgcgatcgacacgaccggtgctcgatttagtagcatactgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactactagctggtaccagcagaaaccaggtcagcctctaagctgctcatttacnggcatctaccggaatccgggtcccctgaccgatcagtgcngcgggtctgggacagtatttcactctcaccatcagcagcctgcaggctagaaagatgtgctagtttatgctgtcagcaatatatatattcctcgtactttcggcctcgggaaccaaagtgaatatacaaaacgtactgtacgctg

SEQ ID NO: 348912 - DNA, 518 bp, Homo sapiens
  misc_feature: GZ8MTXP02I1IGA.45.37.D04.1.454.CMB.2.raw
  modified_base (356)..(356): a, c, t, g, unknown or other
  misc_feature (356)..(356): n is a, c, g, or t
  modified_base (370)..(370): a, c, t, g, unknown or other
  misc_feature (370)..(370): n is a, c, g, or t
  modified_base (413)..(413): a, c, t, g, unknown or other
  misc_feature (413)..(413): n is a, c, g, or t
tcagacgcgatcgacacgaccggtgctcgatttagtagcatactgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagctggtaccagcagaaaccaggtcagcctcctaagctgctcatttactggcatctacccgggaatccggggtcccctgaccgattcagtggcngcgggtctgggacngatttcactctcaccatcagcagccctagccaggctagaaagnttggtggctagtttatgctgtcagacaattattattatacttcctcgtactttcggcccttagggaaccctaagtcggaatactacaaaacgactgtcggcctag

SEQ ID NO: 348913 - DNA, 549 bp, Homo sapiens
  misc_feature: GZ8MTXP02HZXCE.45.37.D04.1.454.CMB.2.raw
  modified_base (437)..(437): a, c, t, g, unknown or other
  misc_feature (437)..(437): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggagagagggccaccatcaactgcaagtccagccagagtgttttagacagctaccaacaataagaactacttagcttggtaccagacagaaaccaggtcagcctacctaagctgctctatttacgtgggactactccgtaaccccggggaatcccggggtccccctgacccgtattcagtggcaggcgggtctaggggacagtacttacacttctcaccatcagcagccctgcaggctagaaagngtgtggacttagtttatgactgtacagataattatattacttaacttcctacgtactttcggcccgttagggaacctaagtcgaataactacaaacgtatcggtagtactcg

SEQ ID NO: 348914 - DNA, 542 bp, Homo sapiens
  misc_feature: GZ8MTXP02GF5AH.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacacggcccctggacaagggcttgagtggagtgggatggatcaaaccccctaacaagtggtggacaacgaaactatgacaacgagtaagtttcgaggggacgaggggtcaaccgataggaccgaaggggaccacggtccatcagcaacagaccctaacagtggacgctagagcaagactagacatcgtagacgacacggacctaatttactacgtgtgcgaggagttcggttaccggtgtcgttggttttccg

SEQ ID NO: 348915 - DNA, 498 bp, Homo sapiens
  misc_feature: GZ8MTXP02GDNMH.45.37.D04.1.454.CMB.2.raw
  modified_base (353)..(353): a, c, t, g, unknown or other
  misc_feature (353)..(353): n is a, c, g, or t
  modified_base (409)..(409): a, c, t, g, unknown or other
  misc_feature (409)..(409): n is a, c, g, or t
  modified_base (411)..(411): a, c, t, g, unknown or other
  misc_feature (411)..(411): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctcaacaataagaactactagcttggtaccagcagaaaccaggtcagcctcctaagctgctcatttactggcatctaccggaatccggggtcccctgaccgattcagtggcngcgggtctgggacagatttcactctcacccatcagcagcctgcaggctgaagatgngnagtttatgctgtcagcaatattattatacgttcctccgactttcgcctggaacctaagtgaatagtacaaacgtactgtcggctacg

SEQ ID NO: 348916 - DNA, 558 bp, Homo sapiens
  misc_feature: GZ8MTXP02JYRIA.45.37.D04.1.454.CMB.2.raw
  modified_base (364)..(364): a, c, t, g, unknown or other
  misc_feature (364)..(364): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacacggcccctggacaagggcttggagtggatgggatggatcaaaccccctaacaagtggtaggacaacaaactntgacaacgagtaagtttcgaggggcaggggtccaccagtcgaccagggacacggtccatcagcacacgcctacagtggagctagagcaagactagactactcgtacggaaccgacgacggacctaattttacgtaaccgtgtacgaacggtaggtacgttacggtttaccgggtcggtccgttggttttacccg

SEQ ID NO: 348917 - DNA, 506 bp, Homo sapiens
  misc_feature: GZ8MTXP02HOBTW.45.37.D04.1.454.CMB.2.raw
  modified_base (289)..(289): a, c, t, g, unknown or other
  misc_feature (289)..(289): n is a, c, g, or t
  modified_base (341)..(341): a, c, t, g, unknown or other
  misc_feature (341)..(341): n is a, c, g, or t
  modified_base (357)..(357): a, c, t, g, unknown or other
  misc_feature (357)..(357): n is a, c, g, or t
  modified_base (421)..(421): a, c, t, g, unknown or other
  misc_feature (421)..(421): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtncgacaggcccctggacaagggcttgagtggatgggatggatccaaccctaanaatggtggcacaactntgcacagaagtttcagggcaggtcacatgacgaggacacgtccatcagcacagcctacatggancgtgagcagactgacatctgacacacggtctactttactacgtgtaacgcgtaaggtactacggtttaccggtggtctttaccgg

SEQ ID NO: 348918 - DNA, 493 bp, Homo sapiens
  misc_feature: GZ8MTXP02HK9J3.45.37.D04.1.454.CMB.2.raw
  modified_base (292)..(292): a, c, t, g, unknown or other
  misc_feature (292)..(292): n is a, c, g, or t
  modified_base (339)..(339): a, c, t, g, unknown or other
  misc_feature (339)..(339): n is a, c, g, or t
  modified_base (352)..(352): a, c, t, g, unknown or other
  misc_feature (352)..(352): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (434)..(434): a, c, t, g, unknown or other
  misc_feature (434)..(434): n is a, c, g, or t
  modified_base (484)..(484): a, c, t, g, unknown or other
  misc_feature (484)..(484): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacnggcccatggacaagggcttgagtggatgggatggatccaaccctaanatggtgcacactntgcacagaagttcagggcagggtcacatgaccagggacacgtccatcagcacagcctantggancngagcagactgacatcngacgacacggcctagtttactacgtgtaagcgaggtactggtttaccggngtctttcgg

SEQ ID NO: 348919 - DNA, 490 bp, Homo sapiens
  misc_feature: GZ8MTXP02GE5MK.45.37.D04.1.454.CMB.2.raw
  modified_base (288)..(288): a, c, t, g, unknown or other
  misc_feature (288)..(288): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtncgacaggcccctggacaagggcttgagtggatgggatggatccaacctacaatggtggcacaactatgcacagaagtttcagggcagggtcaccatgaccagggacacgtccatcagcacagcctacatggagctgagcagactgacatctgacgacacggccatttactactgtgcgaggatgtttaccggtggctttcgg

SEQ ID NO: 348920 - DNA, 509 bp, Homo sapiens
  misc_feature: GZ8MTXP02FXHQW.45.37.D04.1.454.CMB.2.raw
  modified_base (358)..(358): a, c, t, g, unknown or other
  misc_feature (358)..(358): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctgaggtgaggaagcctggggcctcagtgaaggtctcctgcaaggcttctggctacaccttcaccggcgactatctccactgggtgcgacaggcccctggacaagggcttgagtggatgggatggatcaaccccctaacaatggtggcacaaactntgcacagaagtttcagggcaggggtcaccatgaccagggacacgtcatcagcacagcctacatggagctgagcagactgacatctgacgacacggcctagtttacttactgtagcgaggtattcggtttaccggtggtcgttggttttccg

SEQ ID NO: 348921 - DNA, 515 bp, Homo sapiens
  misc_feature: GZ8MTXP02H6YHW.45.37.D04.1.454.CMB.2.raw
  modified_base (248)..(248): a, c, t, g, unknown or other
  misc_feature (248)..(248): n is a, c, g, or t
  modified_base (495)..(495): a, c, t, g, unknown or other
  misc_feature (495)..(495): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcccggggctcagtgaggtctctgcaaggcttcnggctacaccttcaccggcgactatctccactggggtgcgacaggccccctggaccaagggcttggagtggatgggatggatcaacctacaatggtggacacaaactatgacacagtaagttcgagggcgagggtcacatacgaccagggacacgtccatcagcacacgcctacagtggagctagagcagactgacatctcgacgacacggctattactactgtagacgaagtcgttacggttacggngtcgttggtttcctttacgg

SEQ ID NO: 348922 - DNA, 527 bp, Homo sapiens
  misc_feature: GZ8MTXP02IZ9R6.45.37.D04.1.454.CMB.2.raw
  modified_base (362)..(362): a, c, t, g, unknown or other
  misc_feature (362)..(362): n is a, c, g, or t
  modified_base (429)..(429): a, c, t, g, unknown or other
  misc_feature (429)..(429): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaggtctcctgcaaggcttctggctacaccttcaccggcgactatctccactgggtgcgacacggcccctggacaaggggcttgagtggagtgggatggatcaaaccccctaacaagtggtggacacaaactntgacacagaagtttcgagggcagggtcaccatacgaccgagggacacgtcactcagcacacgcctanagtggagtacagacgacagactgacattcacgacgacacggactaactttatactgtgaacgaggtagttcggttaccggtggtcgtttggttttccg

SEQ ID NO: 348923 - DNA, 503 bp, Homo sapiens
  misc_feature: GZ8MTXP02H4KFS.45.37.D04.1.454.CMB.2.raw
  modified_base (356)..(356): a, c, t, g, unknown or other
  misc_feature (356)..(356): n is a, c, g, or t
tcagacgcgatcgacacgaccggtgctcgatttagtagcatactgttgggtttgggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttactggcatcctacccggaatccggggtcccctgaccgattcagtggcngcgggtctgggacagatttcactctcaccatcagcagccagcaggctagagatgtggctagttatgctgtctagcaatattattatataccttcgtactttcggccttagggacctaagtcgaatatacaaacgtactgtcgactcg

SEQ ID NO: 348924 - DNA, 510 bp, Homo sapiens
  misc_feature: GZ8MTXP02IZV92.45.37.D04.1.454.CMB.2.raw
  modified_base (426)..(426): a, c, t, g, unknown or other
  misc_feature (426)..(426): n is a, c, g, or t
  modified_base (500)..(500): a, c, t, g, unknown or other
  misc_feature (500)..(500): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacacggcccctggacaagggcttgagtggatgggatggatccgaaccctaacaatggtggacaacaactatgacacagaagtttcgagggcagggtcaccatgacccgagggacacgtcatcagacacagacctanactggagctgagcagctagacattcagacgacgacggctatttactactgtaagcgaggtactcgtttaccggnggtctttcgg

SEQ ID NO: 348925 - DNA, 605 bp, Homo sapiens
  misc_feature: GZ8MTXP02G0C0U.45.37.D04.1.454.CMB.2.raw
  modified_base (386)..(386): a, c, t, g, unknown or other
  misc_feature (386)..(386): n is a, c, g, or t
  modified_base (448)..(448): a, c, t, g, unknown or other
  misc_feature (448)..(448): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgaggagggccaccatcaactgcaagtccagccagagttgttttagacagctaccaaacaaataagaactacttagcttaggtaccagacaagaaaccaggtacagcctacctaagctgctctatttacgtgggctactccgtaccccggggaacgttcccggggtcccccctgacccgtattcaggtggcngggcgggtcgtgggacagtactttcactctcaccatcagcacgcctgcgagctaggaaagtntggtacggacttagtttattgctgtacagtactaaatttattaattacttactttcccgtaccgttaaccgtttcgggacccctttacgggggaaacccttaaaagggtacggtaaattaacgtaaccgaaaacgtaccgtaggttacggtactacg

SEQ ID NO: 348926 - DNA, 570 bp, Homo sapiens
  misc_feature: GZ8MTXP02HN50X.45.37.D04.1.454.CMB.2.raw
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagcccactccccaggtgcagctggtgcagtctggggctgaggtgaggaagcctggggcctcagtgaaggtctcctgcaaggcttctggctacaccttcaccggcgactatctccactggggtgcgacacggccccctggacaaggggcttggagtggagtggggatgggatccaaaccctaacaatggtgcaacaaaactatgcacagtaagtttcgagggcagggtcaccatcgaccgagggacacgtccatcagcacagcctanatgganctgagcagactgaactagtctacgacgacgacggtacctaaagttttacttaaccgttggtacgacggtaaggtaacgtttacgggttttacccgggtggttccgtttcgggtttttacccgtttttacggg

SEQ ID NO: 348927 - DNA, 532 bp, Homo sapiens
  misc_feature: GZ8MTXP02HPL96.45.37.D04.1.454.CMB.2.raw
  modified_base (360)..(360): a, c, t, g, unknown or other
  misc_feature (360)..(360): n is a, c, g, or t
  modified_base (453)..(453): a, c, t, g, unknown or other
  misc_feature (453)..(453): n is a, c, g, or t
  modified_base (513)..(513): a, c, t, g, unknown or other
  misc_feature (513)..(513): n is a, c, g, or t
tcagacgcgatcgacacgaccggtgctcgatttagtagcatactgttgggtttgggggcatcaccccagcaaccacatctgtcctctagagaatccccctgagagctccgttcctcaccatggactggacctggaggatcctcttcttggtggcagcagccacaagagcccactccccaggtgcagctggtgcagtctggggctgaggtgaggaagccgtggggcctcagtgaaggtctcctgcaaggcttctggctacaccttcaccggcgactatctccactgggtgcgacacgggccccctggacaaggggcttggagtggatgggatgggatcaaaccctaacaatggtggacaanaaaactatgacaacagtaagtttcgaggggcagggtacaaccgatacgaccaggggaccacgtacccatcagcacacgcctaacagtggagcngagcagactgacatcagacacacgcctatttactactgtgcgaaggtatacgtttacggngtcttggtttccctttagg

SEQ ID NO: 348928 - DNA, 521 bp, Homo sapiens
  misc_feature: GZ8MTXP02GG80R.45.37.D04.1.454.CMB.2.raw
  modified_base (360)..(360): a, c, t, g, unknown or other
  misc_feature (360)..(360): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacacggccccctggacaagggcttgagtggatgggatggatcaaccccctaacaatggtggacaacaaactntgcacagtaagttcgagggcagggtcaccatcgacgagggacacgtcatcagcacngcctanagtggagctgagacagactgacatcgtacgacgacacggacctatttactactgtcgcgaggtacgttacggtttacggtcggtcgttcggtttttccg

SEQ ID NO: 348929 - DNA, 657 bp, Homo sapiens
  misc_feature: GZ8MTXP02G9RMI.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatcaactgcaagtccagccagagttgttttagacagctaccaacaataagaactactagcttggtaccagcaagaaaccaggtcacgcctacctaagctagctactatttacgtggcacgtccgtaacccgggacgtcccggggtccccctagacccgtattccgaggtcggcgagggtcggggtcgtagggggacctaggtactttccaaccttccctaccaccctataccgacgccacgtcctcgaccgaggacctaggaaaagtgttcgggtaggtaccttaggttttattggtaccgttgttaccgagtaacttaaatttactttaattaactttacttccccgtttacggttcccgttttaccgggaccccgttagggtaaacccgtaaggttacggtaacttaacgttaaaccgaaacgtaaccgtggtacggtcttaacgg

SEQ ID NO: 348930 - DNA, 504 bp, Homo sapiens
  misc_feature: GZ8MTXP02HN6WL.45.37.D04.1.454.CMB.2.raw
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (287)..(287): a, c, t, g, unknown or other
  misc_feature (287)..(287): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (430)..(430): a, c, t, g, unknown or other
  misc_feature (430)..(430): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctnagtgaaggtctcctgcaaggcttcnggctacaccttcactggcgactatctccactgggtncgacaggcccctggacagggcttgagtggatgggatggatcccaaccctaanatggtgcanactatgacacagtaagtttcgagggacagggtcaccgagtcgaccgaggggaccacgtccatcgagcacagcctacatgganctgagcagactgacatcagacgacacggctatttactactgtcgacgagtactggttaccggtggtcgtttcgg

SEQ ID NO: 348931 - DNA, 523 bp, Homo sapiens
  misc_feature: GZ8MTXP02ILU8M.45.37.D04.1.454.CMB.2.raw
  modified_base (223)..(223): a, c, t, g, unknown or other
  misc_feature (223)..(223): n is a, c, g, or t
  modified_base (353)..(353): a, c, t, g, unknown or other
  misc_feature (353)..(353): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggagctgggctnagtgagtctctgcaggcttctggctacaccttcaccggcgactatcctccacgtgggtgcgacacggcccctggacaagggcttgagtggatgggatggatccaacccctacaatggtggcaacaaactntgacacagaagtttcgagggcagggtcaccgatacgacgagggacacgtccatcagcaacacgcctaacagtggaacgtcgagagcagactagacatctacgacgacaccggcctaatttacgtactgtgaacgtagcgttacgttacggtgtacgtttcggttttaccg

SEQ ID NO: 348932 - DNA, 534 bp, Homo sapiens
  misc_feature: GZ8MTXP02IAZO7.45.37.D04.1.454.CMB.2.raw
  modified_base (360)..(360): a, c, t, g, unknown or other
  misc_feature (360)..(360): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggaagctggggcctcagtgaggtctcctgcaaggcttctggctacaccttcaccggcgactatctccactgggtgcgacaggcccctggacaaggggcttggagtggagtgggatgggatcaacccctaacaatggtggcaacaaactntgcacagtaagtttcgagggcaggggtacacccagtcgaccgagggacacgtccatcagcacacgcctaacagtggagctagagcgagactgactatctgaacgacacggacctaatttactacgttgtgaacgtaggtacttacggtttaccggtcggtcgttcggttttccg

SEQ ID NO: 348933 - DNA, 523 bp, Homo sapiens
  misc_feature: GZ8MTXP02IHG10.45.37.D04.1.454.CMB.2.raw
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
  modified_base (386)..(386): a, c, t, g, unknown or other
  misc_feature (386)..(386): n is a, c, g, or t
  modified_base (448)..(448): a, c, t, g, unknown or other
  misc_feature (448)..(448): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctaccaacaataagaactacttagcttggtaccagcaagaaaccaggtacacgcctacctaagctgctcatttactggcatccgtacccgggaagtcccgggtcccctcgaccgattcgagtggcnggcgggtcngggacagtntttcactctacaccatcagcagccctgcaggctagaaagatgtggactagtttatgctgtanagataattattattatacttcctacgtactttcggccctaggacctaagtgaatacacaaaacgatcgtgctacg

SEQ ID NO: 348934 - DNA, 522 bp, Homo sapiens
  misc_feature: GZ8MTXP02JH3A5.45.37.D04.1.454.CMB.2.raw
  modified_base (359)..(359): a, c, t, g, unknown or other
  misc_feature (359)..(359): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggctcagtgaggtctcctgcaaggcttctggctacaccttcaccggcgactatcctccactgggtgcgacaggcccctggacaagggcttgagtggatgggatggatcaaccccctaacaagtggtaggcaacgaaactntgcacagaagtttcagggcagggtcaccatacgaccgagggacacgtcatcagcacacgacctacatgggagctgagcagactgacatcgtacgacgacacggcctaatttacttactgtagcgtaggtacgttacggttaccggtggtcgttggttttcccg

SEQ ID NO: 348935 - DNA, 535 bp, Homo sapiens
  misc_feature: GZ8MTXP02HNI0P.45.37.D04.1.454.CMB.2.raw
  modified_base (250)..(250): a, c, t, g, unknown or other
  misc_feature (250)..(250): n is a, c, g, or t
  modified_base (287)..(287): a, c, t, g, unknown or other
  misc_feature (287)..(287): n is a, c, g, or t
  modified_base (438)..(438): a, c, t, g, unknown or other
  misc_feature (438)..(438): n is a, c, g, or t
  modified_base (449)..(449): a, c, t, g, unknown or other
  misc_feature (449)..(449): n is a, c, g, or t
  modified_base (516)..(516): a, c, t, g, unknown or other
  misc_feature (516)..(516): n is a, c, g, or t
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagcccactccccaggtgcagctggtgcagtctgggggctgaggtgaggaagcctgggggcctcagtgaggtctcctgcaggctntggctacaccttcaccggcgactatctccactgggtncgacagggccccctggacaaggcttggagtggagtggggatgggatacaaaccctaaccaagtggtggacaacaaaactatcgacacaagtaagtttcgaagggcagggtcacatagaccgagggacacgtccatacagcacagccctaanatggagctagngacagactgacatcagacgacgacgcctattacttcgtagtcgacgaagtcgttacggtttaccggnggtctggttttcctttagg

SEQ ID NO: 348936 - DNA, 504 bp, Homo sapiens
  misc_feature: GZ8MTXP02ITVG4.45.37.D04.1.454.CMB.2.raw
  modified_base (357)..(357): a, c, t, g, unknown or other
  misc_feature (357)..(357): n is a, c, g, or t
  modified_base (441)..(441): a, c, t, g, unknown or other
  misc_feature (441)..(441): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctgggggcctcagtgaaggtctcctgcaaggcttctggctacaccttcaccggcgactatctccactgggtgcgacaggccccctggacagggcttgagtggatgggatggatcaacccctaacaatggtggcacaaactntgcacagaagtttcaggggcaggggtcaccatgaccagggacacgtcatcagcacagcctacatcggagctgagcagactgacntctgacgacacggacctatttactactgtgcgaggattcggttacggtgtcgttggttttccg

SEQ ID NO: 348937 - DNA, 529 bp, Homo sapiens
  misc_feature: GZ8MTXP02HGULT.45.37.D04.1.454.CMB.2.raw
  modified_base (363)..(363): a, c, t, g, unknown or other
  misc_feature (363)..(363): n is a, c, g, or t
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
  modified_base (463)..(463): a, c, t, g, unknown or other
  misc_feature (463)..(463): n is a, c, g, or t
  modified_base (472)..(472): a, c, t, g, unknown or other
  misc_feature (472)..(472): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagctggggcctcagtgaaggtctcctgcaaggcttctggctacaccttcaccggcgactatctccactggggtgcgacacggcccctggaccaaggggcttggagtggatgggatggatcaaaccccctaacaatggtagcaacaaactntgacaacgagtaagtttcgaggggtccaggggtcaaccatgaacccagggacacgtaccatcagcacagaccctanatggganctagagcagactgaacntctgacganacggactatttactactgtgaacgtagagttcgttaccggtgtcgtttcgttttccg

SEQ ID NO: 348938 - DNA, 511 bp, Homo sapiens
  misc_feature: GZ8MTXP02IM9PM.45.37.D04.1.454.CMB.2.raw
  modified_base (356)..(356): a, c, t, g, unknown or other
  misc_feature (356)..(356): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggctcagtgaaggtctcctgcaaggcttctggctacaccttcaccggcgactatctccactgggtgcgacaggcccctggacaagggcttgagtggatgggatggatcaaccccctaacaatggtggcacaaactntgcacagaagtttcagggtcagggtcaccatgaccagggacacgtccatcagcacagcctacatcggagctgagcagactgacatactcgacgacacggcctatttacttactgtgaacgaggtacgtcgtttaccggtggtctttggttttccg

SEQ ID NO: 348939 - DNA, 499 bp, Homo sapiens
  misc_feature: GZ8MTXP02HIDRM.45.37.D04.1.454.CMB.2.raw
  modified_base (343)..(343): a, c, t, g, unknown or other
  misc_feature (343)..(343): n is a, c, g, or t
  modified_base (359)..(359): a, c, t, g, unknown or other
  misc_feature (359)..(359): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
  modified_base (475)..(475): a, c, t, g, unknown or other
  misc_feature (475)..(475): n is a, c, g, or t
  modified_base (490)..(490): a, c, t, g, unknown or other
  misc_feature (490)..(490): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatctccactgggtgcgacaggcccctggacaagggcttgagtggatgggatggatcccaaccctaanagtggtgacacaactntgcacagtaagttcgagggcagggtcacatcgacgagggacacgtccatcagacacagccctanatggancgtgagcagactagacatcagacacgacgacctattactactgcgngagtatgttaccggngtctttcgg

SEQ ID NO: 348940 - DNA, 524 bp, Homo sapiens
  misc_feature: GZ8MTXP02ILJEO.45.37.D04.1.454.CMB.2.raw
  modified_base (357)..(357): a, c, t, g, unknown or other
  misc_feature (357)..(357): n is a, c, g, or t
  modified_base (505)..(505): a, c, t, g, unknown or other
  misc_feature (505)..(505): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagccgtggggcctcagtgaaggtctcctgcaggctctggctacaccttcaccggcgactatctccactgggtgcgacaggccccctggacaagggcttgagtggatgggatggatcaacccctaacaatggtagcacaaactntgacacagaagtttcgagggtcagggtcacatgacagggacacgtccatcagcacacgcctacagtggagctgagacagactgacatctagacgacacggcctaatttactaacttgtaggaacgaggtaacgttcggtttaaccggnggttcgttcggtttttccg

SEQ ID NO: 348941 - DNA, 634 bp, Homo sapiens
  misc_feature: GZ8MTXP02HXFEF.45.37.D04.1.454.CMB.2.raw
  modified_base (451)..(451): a, c, t, g, unknown or other
  misc_feature (451)..(451): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactcccaggtgcagctggtgcagtctgggctgaggtgaggaagctggggcctcagtgaaggtctcctgcaaggcttctggctacacccttcacccggcgactatctccactgggtgcgacacggccccctggacaagggcttggagtggatggggatggatcaaaccccctaacaaagtggtcggacaacaaaactgtagacaaccgaagtaaacgtttcgaaggggtacacgggggtaccaacccgatacgaacccgagggggaaccaccggtccaanaccgagaccaacgacgaccccttaacagtaggagccgtagacgaccaaggaccttaggaacctactactacggaacccgacgaaccgggtaccctaaagtttttactaaccgttggttacggaaccggtaagggtactttacggggtttaaccgggtcggtacggtttacggtttttcccggg

SEQ ID NO: 348942 - DNA, 529 bp, Homo sapiens
  misc_feature: GZ8MTXP02GD3D5.45.37.D04.1.454.CMB.2.raw
  modified_base (312)..(312): a, c, t, g, unknown or other
  misc_feature (312)..(312): n is a, c, g, or t
  modified_base (365)..(365): a, c, t, g, unknown or other
  misc_feature (365)..(365): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactactagcttggtaccagacagaaaccaggtcagcctctaagctgctcatttacgnggcatccgtacccgggaactccggggtccccctgacccgtattccgagtggcnggcgggtctggggacagtatttcactctcacccatcagcacgcctgctagggctagaagtagtggtggtactagtttatgctgtcagactaattattattatacttcctcgtactttcggaccttgggaaccaaggtgaatactacaaacgtatggtcgactcg

SEQ ID NO: 348943 - DNA, 546 bp, Homo sapiens
  misc_feature: GZ8MTXP02HWLE4.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctgggctgaggtgaggagcctgggcctcagtgaggtctcctgcaaggctctggctacaccttcaccggcgactatcctccacgtgggtcgcgaccgacggcccccgtaggaaccgaaggggtcttggaggttggagtggggatggataccaacccctaacaagtggtaggacaacaaactatgacacgagtaagtttcgagggtcagggtacaccgatcgaccgagggacaccgtcatcagcacacgacctacgagtggagctgacgcagactgacatctagacgacacggcctaatttactacgtgtagcgtaggtattacggttaccggtggtcgtttcggttttacg

SEQ ID NO: 348944 - DNA, 516 bp, Homo sapiens
  misc_feature: GZ8MTXP02JGHLT.45.37.D04.1.454.CMB.2.raw
  modified_base (357)..(357): a, c, t, g, unknown or other
  misc_feature (357)..(357): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaggcttctggctacaccttcaccggcgactatctccactgggtgcgacaggcccctggacaagggcttgagtggatgggatggatcaaccccctacaatggtaggacacaaactntgcaacagtaagtttcgagggtcagggtcaccatcgaccgagggacacgtcatcagcacagcctacagtggagctagagacgagactgacatctacgacgacacggactagtttactactgtgcgagtacgtcggttacgtcggtcgttcggtttaccg

SEQ ID NO: 348945 - DNA, 579 bp, Homo sapiens
  misc_feature: GZ8MTXP02IIH74.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacaccttcaccggcgactatctccacgtgggtgcgacgacggccccctggacaagggcttggagtggatgggatggatcaaaccccctaacaatggtaggacaacaaactatcgacacaagtaagtttcgaagggtcgacgggtacaacccagtacgaccgaagggacaccggtaccaatcgacgacacacgcctaactagtaggacgactgacgacgaacgacacgactaactccgtacggaaccgacgaccggtacctaattttacttacgtagtgaacggtaggtacgttcggttaccggtcggtcgtttcggtttttcccgg

SEQ ID NO: 348946 - DNA, 512 bp, Homo sapiens
  misc_feature: GZ8MTXP02I8H6I.45.37.D04.1.454.CMB.2.raw
  modified_base (361)..(361): a, c, t, g, unknown or other
  misc_feature (361)..(361): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaaacaataagaactacttagcttggtaccagcaagaaaccaggtcagcctcctaagctgctcatttactgggcatcctaccgggaatccggggtcccctgaccgattcagtggcnggcgggtctgggacagatttcactctcaccatcagcagccctgcaggctagaaagatgtgctagtttattgctgacagacaattattatatattcctacgtactttcgcctacggaacctaaggtcgaatacacaaacgactgacgctacg

SEQ ID NO: 348947 - DNA, 523 bp, Homo sapiens
  misc_feature: GZ8MTXP02GSAWN.45.37.D04.1.454.CMB.2.raw
  modified_base (429)..(429): a, c, t, g, unknown or other
  misc_feature (429)..(429): n is a, c, g, or t
tcagacgcgatcgacacgaccggtgctcgatttagtagcatactgttgggtttgggggcatcaccccagcaaccacatctgtcctctagagaatccccctgagagctccgttcctcaccatggactggacctggaggatcctcttcttggtggcagcagccacaagagccccactccccaggtgcagctggtgcagtctgggggctgaggtgaggaagcctgggggcctcagtgaaggtctcctgcaaggcttctggctacacccttcaccggcgactatctccactgggtgcgacaggccccctggacaagggcttgagtggagtgggatggatcaacctaacatggtgcacaaactatgcacagtagtttcgagggcagggtcacatcgacagggacacgtccatcagcacacgcctaacagtggancgtagagcagactgacatctacgacgacacggcctatttacttacgtgtgacgtaagtagttacgtttaccggtgtcgttcggtttctttacgg

SEQ ID NO: 348948 - DNA, 573 bp, Homo sapiens
  misc_feature: GZ8MTXP02HCGPI.45.37.D04.1.454.CMB.2.raw
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
  modified_base (242)..(242): a, c, t, g, unknown or other
  misc_feature (242)..(242): n is a, c, g, or t
  modified_base (337)..(337): a, c, t, g, unknown or other
  misc_feature (337)..(337): n is a, c, g, or t
  modified_base (359)..(359): a, c, t, g, unknown or other
  misc_feature (359)..(359): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggacgcgtgggctnagtgagtctcngcagctngctacactcaccggcgactatctccacgtggtgcgacgacggccccgtggaacgaagggtctggagtggagtgggatggactacaaacccctaanaacgtggtcgacaaacaaactntcgacaacgaagtaagtttcgagggacgagggtcacatcgacgaggacacgtacatcagcaacacgtacctacgagtagggacgtacgacgagacgaacggactaggaccattcgacgaacgacgaccggtacttaaactttacttaaccgtggttacggaacggtaggtagtttaccgggtttacggcggttcggtttcggttttttacccgg

SEQ ID NO: 348949 - DNA, 659 bp, Homo sapiens
  misc_feature: GZ8MTXP02IF7SJ.45.37.D04.1.454.CMB.2.raw
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggctcgtggctacaccttcaccggcgactatcctccacgtgggtcgcgacgacggcccccgtggacgaagggtcttggaggtggagtgggatggactacccgaaaccctaacaagtggtagacaacaactagtgacaacaagtaagtttacgaacgggcgaggggtaccaacgagtacgaaccgacggggaccaacggtaccaacgtccaacgaccaacgaacgacccttaagacgttagggaacgtcgacggaacggaccgaacggtaaccgtaggaaacctacgttaccggtaacggaacccggaaaccgaccgggttaccttaacgttttaacgttaacgttcggtaacggacggtaacgggttacggtttacgggtttacccgggttggtttccggttttaccgggg

SEQ ID NO: 348950 - DNA, 546 bp, Homo sapiens
  misc_feature: GZ8MTXP02G8ZGC.45.37.D04.1.454.CMB.2.raw
  modified_base (345)..(345): a, c, t, g, unknown or other
  misc_feature (345)..(345): n is a, c, g, or t
  modified_base (362)..(362): a, c, t, g, unknown or other
  misc_feature (362)..(362): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctctgcaaggcttctggctacaccttcgaccggcgactatcctccactgggtgcgacacggccccctaggacaagggtcttgagtggagtgggatggatacaacccctanagtggtgacacaaactntcgacacgagtagttcgagggcgagggtacaccgatacgacgagggacacgtccagtcagcacgacgcctacagtcggagcagacgacagactgacagtacgacgacacgacggaccttagtttacttacgtgtagaacggtaggtacgtttacggttaccggtggttcggttcgtttttccgg

SEQ ID NO: 348951 - DNA, 615 bp, Homo sapiens
  misc_feature: GZ8MTXP02IQRWN.45.37.D04.1.454.CMB.2.raw
  modified_base (225)..(225): a, c, t, g, unknown or other
  misc_feature (225)..(225): n is a, c, g, or t
  modified_base (350)..(350): a, c, t, g, unknown or other
  misc_feature (350)..(350): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtgggcctnagtgaaggtctcctgcaaggcttctggctacaccttcgaccggcgactatcctccacgtgggtgcgacgacggcccctggaccgaagggcttggagtggagtgggatggactacaaacccctaanagtggtcggacaacaaactgtacgacacgagtaacgttacgagggacgagggtacaccgagtacgaccgagggacacgtaccatacgagacacacgacctaacgagtggacgacgtgacgacgaagacgtagactactacgtacggaacgtaccgaaccggtaccttaaattttacgttaaaccgttggtacgtaaccgggtaggtaacggttttaccgggtttaaccggtacgggtttaccggttttacgggttttttacccgg

SEQ ID NO: 348952 - DNA, 528 bp, Homo sapiens
  misc_feature: GZ8MTXP02IDZN8.45.37.D04.1.454.CMB.2.raw
  modified_base (352)..(352): a, c, t, g, unknown or other
  misc_feature (352)..(352): n is a, c, g, or t
  modified_base (418)..(418): a, c, t, g, unknown or other
  misc_feature (418)..(418): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgtagctggtgcagtctggggctgaggtgaggaagcctggggcctcagtgaggtctcctgcaaggcttctggctacaccttcaccggcgactatctccactgggtgcgacaggcccctggacaagggcttgagtggatgggatggatcaacctacaatggtgcacaaactntgcacagaagttcgagggcagggtcacagtgacgagggacacgtcatcagcacagcctacatgganctgagcagctgacatctgaacgacgacggacctaatttacttactggttacgcggtaaggtagttacggttttacccgggtggtccgtttcggtttcccgtttttacggg

SEQ ID NO: 348953 - DNA, 501 bp, Homo sapiens
  misc_feature: GZ8MTXP02F4WFG.45.37.D04.1.454.CMB.2.raw
  modified_base (225)..(225): a, c, t, g, unknown or other
  misc_feature (225)..(225): n is a, c, g, or t
  modified_base (356)..(356): a, c, t, g, unknown or other
  misc_feature (356)..(356): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (461)..(461): a, c, t, g, unknown or other
  misc_feature (461)..(461): n is a, c, g, or t
  modified_base (484)..(484): a, c, t, g, unknown or other
  misc_feature (484)..(484): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctnagtgaaggtctctgcaggcttctggctacaccttcaccggcgactatctccactgggtgcgacacggcccctggacaagggcttgagtggatgggatggatcaacccctaacaagtggtggacacaaactntgcacagaagttcagggcagggtcacatgacgagggacacgtacatcagcacagacctacatggagctgagcagactgacntcncgacacacgctatttactacngtagcgtaggacgtgttaccggnggtcgttcggtttaccg

SEQ ID NO: 348954 - DNA, 512 bp, Homo sapiens
  misc_feature: GZ8MTXP02JQ0Q4.45.37.D04.1.454.CMB.2.raw
  modified_base (289)..(289): a, c, t, g, unknown or other
  misc_feature (289)..(289): n is a, c, g, or t
  modified_base (448)..(448): a, c, t, g, unknown or other
  misc_feature (448)..(448): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtncgacaggcccctggacaagggcttgagtggatggggatgggatcccaaccctaacaatggtggcaacaacctatgcacagaagtttcagggcagggtcaccgatgaccgaggacacgtccatcagcacagcctacatggagctgagcagactgacatcngacgacacggcctagtttacttaactgtcgcgtacggacttcggtttaccggtggtctttcggg

SEQ ID NO: 348955 - DNA, 521 bp, Homo sapiens
  misc_feature: GZ8MTXP02G5NA2.45.37.D04.1.454.CMB.2.raw
  modified_base (361)..(361): a, c, t, g, unknown or other
  misc_feature (361)..(361): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacaccttcaccggcgactatctccactgggtgcgacacggccccctggaccagggcttggagtggatgggatggatcaaccccctaacaagtggtagacacaaactntgcacagtaagtttcagggcagggtcaccatcgacgaggacacgtcatcagcacagcctacatggagctagagacagactgacatactacgaccgacaccggacctagtttactactgtagcgaggtacttcggttaccggtggtcgttcggttttaccg

SEQ ID NO: 348956 - DNA, 547 bp, Homo sapiens
  misc_feature: GZ8MTXP02H7L2K.45.37.D04.1.454.CMB.2.raw
  modified_base (321)..(321): a, c, t, g, unknown or other
  misc_feature (321)..(321): n is a, c, g, or t
  modified_base (353)..(353): a, c, t, g, unknown or other
  misc_feature (353)..(353): n is a, c, g, or t
  modified_base (369)..(369): a, c, t, g, unknown or other
  misc_feature (369)..(369): n is a, c, g, or t
  modified_base (428)..(428): a, c, t, g, unknown or other
  misc_feature (428)..(428): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctaccaacaaataagaactacttagcttaggtacccagcaagaaaccaggtcagccctcctaaagctagctcatttacngggcatcctacccgggaatcccggggtccccngaccgattcagtggcnggcgggtctggacagtatttcactctcaccatccagcagcctgcaggctagaagatggnggctagtttatgctgtacagtactaaattattattatacttcctccgtactttccggcccttagggaaccctaaaggttcggaattactaacgaaaaccgtaactggtacggtctaccg

SEQ ID NO: 348957 - DNA, 496 bp, Homo sapiens
  misc_feature: GZ8MTXP02GS7AR.45.37.D04.1.454.CMB.2.raw
  modified_base (357)..(357): a, c, t, g, unknown or other
  misc_feature (357)..(357): n is a, c, g, or t
  modified_base (425)..(425): a, c, t, g, unknown or other
  misc_feature (425)..(425): n is a, c, g, or t
  modified_base (483)..(483): a, c, t, g, unknown or other
  misc_feature (483)..(483): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaggtctctgcaaggcttctggctacaccttcaccggcgactatctccactgggtgcgacaggccccctggacaagggcttgagtggatgggatggatcaaccccctaacaactggtggcacgaaactntgcacagtaagtttcagggcaggggtcaccatgacagggacacgtccatcagcacagcctacatgganctgagcagactgacatctgacgacacggccatttactactgtgcgaggatgttacggnggtctggtttccg

SEQ ID NO: 348958 - DNA, 502 bp, Homo sapiens
  misc_feature: GZ8MTXP02G90SG.45.37.D04.1.454.CMB.2.raw
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatgggatggatccgaaccctaacaagtggtggcaacaactatgcacagtaagtttcgagggcagggtcacatgacccgaggacacgtcatcagcacagcctacatggagctgagcagactgacatcagacgacgacggacctatttactactgtgcgaggtatcggttacggtgtcgtttcgg

SEQ ID NO: 348959 - DNA, 607 bp, Homo sapiens
  misc_feature: GZ8MTXP02GIOQJ.45.37.D04.1.454.CMB.2.raw
  modified_base (348)..(348): a, c, t, g, unknown or other
  misc_feature (348)..(348): n is a, c, g, or t
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagcccactccccaggtgcagctggtgcagtctgggggctgaggtgaggaagcctggggcctcagtgaaggtctcctgcaaggcttctggctacaccttcaccggcgactatctccactgggtgcgacacggccccctggacaaggggcttggagtggatggggatgggatcgaaaccctaanaagtggtggactaacaaaactatgacaacaagtaagttcgaagggcagggtaccacgatacgacgagggaaccacgtccactcagacaacgacgccctaaacagtaggacgacgtagaacgacgaagtaacgtacgaactacgtacgtaacggaaccgaaccgacggtaccttaaagtttaacgttacgtaggtacgaacggtaaggttacgtttacggttaccgggttcggttacggtttacggttttacgtttacgg

SEQ ID NO: 348960 - DNA, 551 bp, Homo sapiens
  misc_feature: GZ8MTXP02JFOU8.45.37.D04.1.454.CMB.2.raw
  modified_base (360)..(360): a, c, t, g, unknown or other
  misc_feature (360)..(360): n is a, c, g, or t
  modified_base (410)..(410): a, c, t, g, unknown or other
  misc_feature (410)..(410): n is a, c, g, or t
  modified_base (428)..(428): a, c, t, g, unknown or other
  misc_feature (428)..(428): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacaccttcaccggcgactatctccactgggtgcgacaggcccctggacaagggcttgagtggatgggatggatcgaaccccctaacaagtggtaggcacaaactntgacacgagaagtttcagggtcagggtcaccatgaccagggacacgtcancagcacagtaccacaagngacgcgagacgacgacgactagacatacgtacgacgaccgaccggtaccttaactttacgttacgttggtacgtaacggtaaggtacgttacggttacggttcggttccgtttacggtttccg

SEQ ID NO: 348961 - DNA, 511 bp, Homo sapiens
  misc_feature: GZ8MTXP02HP8D2.45.37.D04.1.454.CMB.2.raw
  modified_base (362)..(362): a, c, t, g, unknown or other
  misc_feature (362)..(362): n is a, c, g, or t
  modified_base (426)..(426): a, c, t, g, unknown or other
  misc_feature (426)..(426): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctgggggcctcagtgaaggtctcctgcaaggcttctggctacacccttcaccggcgactatctccactggggtgcgacaggccccctggacaagggcttgagtggatggggatggatcaaccccctaacaatggtggcaacaaactntagcacagaagtttcagggcagggtcacatgacaggacacgtcatcagcacagcctacatggancgtgagcaggactagacatctacgacgacacggccatttactactgtcgcgagagttcggttacggtggtcgttcggttttaccg

SEQ ID NO: 348962 - DNA, 509 bp, Homo sapiens
  misc_feature: GZ8MTXP02JJ06H.45.37.D04.1.454.CMB.2.raw
  modified_base (360)..(360): a, c, t, g, unknown or other
  misc_feature (360)..(360): n is a, c, g, or t
  modified_base (494)..(494): a, c, t, g, unknown or other
  misc_feature (494)..(494): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacacggcccctggacaagggcttgagtggatgggatggatcaaccccctaacaagtggtggcaacaaactntgcaacagaagtttcagggcagggtcaccatgaccagggacacgtcatcagcacacgcctacagtggagctgagcagactgacatctacgacgacacggctaatttactacgtgtgcgaggatcggttaccggnggtacttggtttccg

SEQ ID NO: 348963 - DNA, 638 bp, Homo sapiens
  misc_feature: GZ8MTXP02GFZ9G.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctggaggtgaggagccgtgggcctgagtgagtctctgcaggctctgctacaccttcgaccggcgactactcctccgacgtgggtcgcgaccgacggccccgtaggacgaagggtcttggagtggagtgggatggactacaaacccctaagagtggtacgacaactaaactgtacgacacgtagtaacgttcgaggggtacgaggggtacaaccgtagtacggaaccgaggggaccaccggtaccaagtcgaacgacaaccgacgtacccgttaacgagtacgggaacgtccgtaggacgacgaacggtaactcggaacctacttaccggtacgaaaccgaccgtaacccggttaccttaagtttacgtacgtggttacggaacggtaaggttacgttacggtttacgggtcggtttccgtttcggtttttaaccgg

SEQ ID NO: 348964 - DNA, 514 bp, Homo sapiens
  misc_feature: GZ8MTXP02INQ35.45.37.D04.1.454.CMB.2.raw
  modified_base (359)..(359): a, c, t, g, unknown or other
  misc_feature (359)..(359): n is a, c, g, or t
  modified_base (431)..(431): a, c, t, g, unknown or other
  misc_feature (431)..(431): n is a, c, g, or t
  modified_base (499)..(499): a, c, t, g, unknown or other
  misc_feature (499)..(499): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtcgtggggctgaggtgaggaagcctggggcctcagtgaaggtctcctgcaaggcttctggctacaccttcaccggcgactatcctccacgtgggtgcgacaggcccctggacaagggcttgagtggatgggatggatcaacccctaacatggtgcaacaaactntgacacgagtaagtttcgagggcagggtcacatgacagggacacgtcatcagcacgacgacctacagtggancgtgagcagactgacatcagacgacacggacctactttagtactgtgcgaggtacttcggttaccggngtccgtggttttccg

SEQ ID NO: 348965 - DNA, 535 bp, Homo sapiens
  misc_feature: GZ8MTXP02H8UQW.45.37.D04.1.454.CMB.2.raw
  modified_base (224)..(224): a, c, t, g, unknown or other
  misc_feature (224)..(224): n is a, c, g, or t
  modified_base (431)..(431): a, c, t, g, unknown or other
  misc_feature (431)..(431): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggagctgggcctnagtgaaggtctcctgcaaggctctggctacaccttcaccggcgactatctccactgggtgcgacaggcccctggacaagggcttgagtggatgggatggatcaaaccccctaacaaagtggtaggcacgaaactatgacacagtaagttcgaggtcagggtcacatgaaccgagggtacacgtccaatcagcacagcctacatgganctgagacagactgacatcgtagaccgacgaaccggcctaatttacttaacgttggttgaacggtaggacgttcggtttaaccggtggtcgtttggtttttcccg

SEQ ID NO: 348966 - DNA, 635 bp, Homo sapiens
  misc_feature: GZ8MTXP02HD0EC.45.37.D04.1.454.CMB.2.raw
  modified_base (343)..(343): a, c, t, g, unknown or other
  misc_feature (343)..(343): n is a, c, g, or t
  modified_base (486)..(486): a, c, t, g, unknown or other
  misc_feature (486)..(486): n is a, c, g, or t
  modified_base (506)..(506): a, c, t, g, unknown or other
  misc_feature (506)..(506): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggcctgtgtctcgtgggcgaggacgggccaccatacaactgacaacgtccacgccagtagttgtttagacagcctaccaaacaataaagaactacttagtcgttacggtaaccagacaacgaaaccgaggtacacgtcctaccgtaagctgctactatttacgnggactactaccgtaacccgggaacttccgtacccggggtcccctacggacccgtacttcgaggttcggcgacgggtcggggtcgtggggacctagtacttccacttcctaccacatcagcacgcctgacgaggctaggaagtntgggtgtacttaggttttancgtcgttaggtaccagtaactaaatttaattaactttacttactttccctaccggtttaccttccgggtacccgacgggtaaccctaaaaggtcgtaacttacgtaacaaaaccgtacgtggtacggtc

SEQ ID NO: 348967 - DNA, 502 bp, Homo sapiens
  misc_feature: GZ8MTXP02JFLEP.45.37.D04.1.454.CMB.2.raw
  modified_base (361)..(361): a, c, t, g, unknown or other
  misc_feature (361)..(361): n is a, c, g, or t
  modified_base (445)..(445): a, c, t, g, unknown or other
  misc_feature (445)..(445): n is a, c, g, or t
tcagacgcgatcgacacgaccggtgctcgatttagtagcatactgttgggtttgggggagcatcacccagcaaccacatctgtcctctagagaatccccctgagagcttcgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatgggatggatcaaccccctaacaatggtaggcaacgaaactntgcaacagaagtttcagggtcagggtcaccatgacagggacacgtcatcagcacagcctacatgagctgagcagactgacatcngacgacacggaccatttatactgtagcgaggatcgttaccggtgtcgtggttttccg

SEQ ID NO: 348968 - DNA, 548 bp, Homo sapiens
  misc_feature: GZ8MTXP02G6YFC.45.37.D04.1.454.CMB.2.raw
  modified_base (462)..(462): a, c, t, g, unknown or other
  misc_feature (462)..(462): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggctctggctacaccttcaccggcgactatcctccactgggtgcgacacggcccctggacaagggcttgagtggatgggatggatcaaccccctaacaagtggtggacaacgaaactatcgacaccgaagtaagtttacgaaggggcagggggtccaacccgatacggaaccgaggggaccaccggtaccatcagcacacgcctacatgggagtccngagacagactgaccatctacgacgacacggctaactttactactgtagcgagtacgttcgttacggtcggtcgttcggttttaccg

SEQ ID NO: 348969 - DNA, 529 bp, Homo sapiens
  misc_feature: GZ8MTXP02GH2E1.45.37.D04.1.454.CMB.2.raw
  modified_base (453)..(453): a, c, t, g, unknown or other
  misc_feature (453)..(453): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctggaggtgaggaagcctggggcctcagtgaaggtctcctgcaaggcttctggctacaccttcaccggcgactatctccactggtgcgacacggcccctggacaagggcttgagtgagtgggatggatcaaacccctaacaatggtggacaacaaactatgacaacgagtaagtttcgagggcagggtcacatgacagggacacgtccagcagcacagcctacgagtggacgcagagcagactgaacatcgngaccgacacggacctaatttactaacgtgtgaacgtaggtagttacggtttaccggtggtcgtttacggttttccg

SEQ ID NO: 348970 - DNA, 501 bp, Homo sapiens
  misc_feature: GZ8MTXP02J1Z0V.45.37.D04.1.454.CMB.2.raw
  modified_base (341)..(341): a, c, t, g, unknown or other
  misc_feature (341)..(341): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatgggatggatccaaccctaanaatggtggcaacactatgcacagaagtttcagggcagggtcacatgacaggacacgtcatcagcacagcctacatggagctgagcagactagacatcgtgacgacgacggcctatttactactgtgcgtaggacttcggtttaccggtggtcgtttcggg

SEQ ID NO: 348971 - DNA, 555 bp, Homo sapiens
  misc_feature: GZ8MTXP02IJCHB.45.37.D04.1.454.CMB.2.raw
  modified_base (363)..(363): a, c, t, g, unknown or other
  misc_feature (363)..(363): n is a, c, g, or t
  modified_base (444)..(444): a, c, t, g, unknown or other
  misc_feature (444)..(444): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcacccggcgactatctccactgggtgcgacacggcccctggacaaggggcttggagtggatggggatggatcaaccccctaacaatggtggcaacaaactntgacacgagaagtttcaggggtcagggtcaccatcgacagggacacgtccatcagcacagcctacatcgggagcctgacgnagactgacagtctagaccgacacggtacctaaattttacttaaccgtgttacgaacggtaagggtacgtttcgggtttaacccgggtggttaccgtttcggtttttcccgg

SEQ ID NO: 348972 - DNA, 536 bp, Homo sapiens
  misc_feature: GZ8MTXP02F298P.45.37.D04.1.454.CMB.2.raw
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaggtctcctgcaaggcttctggctacaccttcaccggcgactatctccactgggtgcgacaggcccctggaccaaggggcttggagtggatgggatggatcaacccctanaatggtggcaacgaaactntgacaacagaagtttcagggcaggggtcaccatgaccgagggacacgtccatcagcacagcctacatggagctagagcgaagtactgaacctatcgtacgaaccgaacgacggcctaatttacttaaccgtgttgaacgtaggacttcggtttaccggtggtctttcggttttcccg

SEQ ID NO: 348973 - DNA, 524 bp, Homo sapiens
  misc_feature: GZ8MTXP02I1IWE.45.37.D04.1.454.CMB.2.raw
  modified_base (341)..(341): a, c, t, g, unknown or other
  misc_feature (341)..(341): n is a, c, g, or t
  modified_base (356)..(356): a, c, t, g, unknown or other
  misc_feature (356)..(356): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatctccactgggtgcgacaggcccctggaccaagggcttgagtggatgggatggatcaacccctaanatgtggcacaaactntgcacagagtttcgagggtcaggggtcaccatcgaccgaggacacgtcagtcagcacacgacctacatggagctgagcagactgacatctacgacgacacggtacctatttactactgtacgaacggtaggtagttacggtttaccggtggtcgtttcggtttttccg

SEQ ID NO: 348974 - DNA, 595 bp, Homo sapiens
  misc_feature: GZ8MTXP02G0EZZ.45.37.D04.1.454.CMB.2.raw
  modified_base (365)..(365): a, c, t, g, unknown or other
  misc_feature (365)..(365): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgtttagacagctaccaaacaataagaactactagcttggtaccagacaagaaaccaggtcagcctacctaagctgctctatttacgtggcatcgtaccgggaagtcccggggtcccctgaccgattcgagtggcngcgggtctgggacagtatttcactctacaccatcagcagcctgccgaggctaggaaagagtggtaggacttagttttagtcgtaccgttggtaccaagtactaaaattatttaattaacttaactttcccctacggttacctttccgggaccccttacggggtaaaaccctaaaggttaggaaaacttaacgttaaccgaaaaacgaacgttacggtagggtacctacgg

SEQ ID NO: 348975 - DNA, 588 bp, Homo sapiens
  misc_feature: GZ8MTXP02IWKDK.45.37.D04.1.454.CMB.2.raw
  modified_base (352)..(352): a, c, t, g, unknown or other
  misc_feature (352)..(352): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatgggatggatccaaacctaacaatggtgcaanaactatgacacagtaagtttcgagggcagggtacaccgatacggaaccgaggggaccacggtccaacgtcagaccaacgacgaccttacgaatgggagaccgtagacgcaaggacctagacacgttcgacggaccgaaccgaaccgggtacccttaagttttaacttaccgttaggttcggaccgggtaaggtacgttacgggttttacccggggtgggttaccgtttttcggggg

SEQ ID NO: 348976 - DNA, 538 bp, Homo sapiens
  misc_feature: GZ8MTXP02HF7LY.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggtagcagccacaagagcccactcccaggtgcagctggtgcagtctggggctgaggtgaggaagcctggggcctcagtgaaggtctcctgcaaggcttctggctacaccttcaccggcgactatctccacgtggtgcgacacggcccctggacaggcttgagtggatgggatggatcgaacctaacaagtggtgacaacaaactatgcacagtaagttcgagggcagggtcacatgaccgaggacacgtccatcagcacagcctacagtggagcgtagagcaggactgacatcgtagaccgacgaccggaccttaattacgttaccgtagtcgacggtaaggtacgttacggtttaccggtggtacgttcggtttaccgttttacgg

SEQ ID NO: 348977 - DNA, 495 bp, Homo sapiens
  misc_feature: GZ8MTXP02HQTQ9.45.37.D04.1.454.CMB.2.raw
  modified_base (359)..(359): a, c, t, g, unknown or other
  misc_feature (359)..(359): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtctgggggctgaggtgaggaagcctgggggcctcagtgaaggtctcctgcaaggcttctggctacaccttcaccggcgactatctccactgggtgcgacaggcccctggacaagggcttgagtggatgggatggatcaaccccctaacaatggtggcacaaactntgcacagaagttcagggcaggggtcaccgatgacagggacacgtcatcagcacagcctacatgagctgagcagactgacatctgacgacacggcctattactactgtgcgaggatggttaccgtggtctgtttccg

SEQ ID NO: 348978 - DNA, 540 bp, Homo sapiens
  misc_feature: GZ8MTXP02GK5LT.45.37.D04.1.454.CMB.2.raw
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
  modified_base (381)..(381): a, c, t, g, unknown or other
  misc_feature (381)..(381): n is a, c, g, or t
  modified_base (425)..(425): a, c, t, g, unknown or other
  misc_feature (425)..(425): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggaagcctggggctcagtgaggtctcctgcaaggcttctggctacaccttcaccggcgactatctccacctgggtgcgacgacggccccctgggaaccaaggggcttgagtggatgggatggatcaacccctaacatggngcacaaatngacacagaagttcagggcagntcacatgaccagggacacgtccatcgacgacaacagaccctaanagtaggagcgagacgacgagactagacatcgtacgaaccgacgtaccgtactacgtttaacttacgtgtaacgtacggtaaggtacgttacggtttaccggtcggtcgtttacgg

SEQ ID NO: 348979 - DNA, 527 bp, Homo sapiens
  misc_feature: GZ8MTXP02FX8BM.45.37.D04.1.454.CMB.2.raw
  modified_base (363)..(363): a, c, t, g, unknown or other
  misc_feature (363)..(363): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatgggatgggatcgaaaccccctaacaatggtaggcaacaaaactntgcaacagaagtttcagggcagggtcaccatgaccgaggacacgtcatcagcacacgcctacatggagctgagcagactgacatcgacgacgaacacggacctaatttacttactggtcgaacgtaggtagttcggttaccgggtgtcgttacggtttttcccg

SEQ ID NO: 348980 - DNA, 515 bp, Homo sapiens
  misc_feature: GZ8MTXP02HAQXO.45.37.D04.1.454.CMB.2.raw
  modified_base (358)..(358): a, c, t, g, unknown or other
  misc_feature (358)..(358): n is a, c, g, or t
  modified_base (434)..(434): a, c, t, g, unknown or other
  misc_feature (434)..(434): n is a, c, g, or t
  modified_base (443)..(443): a, c, t, g, unknown or other
  misc_feature (443)..(443): n is a, c, g, or t
  modified_base (446)..(446): a, c, t, g, unknown or other
  misc_feature (446)..(446): n is a, c, g, or t
  modified_base (500)..(500): a, c, t, g, unknown or other
  misc_feature (500)..(500): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatgggatggatcgaaccccctaacaatggtggcacaaactntgcacagaagtttcgagggcaggggtcaccgatagaccaggggacacgtccatcagcgacagcctacgatggagcngagcagtanganatcgtagacgacacggacctatttacgtactgtcgcgtagagttcgttaccggnggtcgtggttttccg

SEQ ID NO: 348981 - DNA, 504 bp, Homo sapiens
  misc_feature: GZ8MTXP02FP591.45.37.D04.1.454.CMB.2.raw
  modified_base (313)..(313): a, c, t, g, unknown or other
  misc_feature (313)..(313): n is a, c, g, or t
  modified_base (356)..(356): a, c, t, g, unknown or other
  misc_feature (356)..(356): n is a, c, g, or t
  modified_base (411)..(411): a, c, t, g, unknown or other
  misc_feature (411)..(411): n is a, c, g, or t
  modified_base (414)..(414): a, c, t, g, unknown or other
  misc_feature (414)..(414): n is a, c, g, or t
  modified_base (416)..(416): a, c, t, g, unknown or other
  misc_feature (416)..(416): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaaacaataagaactacttagcttggtaccagcagaaaccaggtcagcctcctaagctgctcatttacnggcatctaccggaatccggggtcccctgaccgattcagtggcnggcgggtctgggacagtatttcactctcacccatcagcagcctgcagctgaaagntgngntagttatgctgcagtataatattattatacttcctcgtacttcgacgtacggactaagtgaatactaacaaacgtacgtgtcgtctcg

SEQ ID NO: 348982 - DNA, 580 bp, Homo sapiens
  misc_feature: GZ8MTXP02I6EGN.45.37.D04.1.454.CMB.2.raw
  modified_base (442)..(442): a, c, t, g, unknown or other
  misc_feature (442)..(442): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatctccactgggtgcgacacggcccctggacagggcttgagtggatgggatggatacaaccccctaacaagtggtagcaacaaactgtgacaacgagtaagtttcgaggggacaggggtcaacatacgaaccgaggacacgtcatcagcacagcctacgagtggacgngtagacgacgacgaactcgaactacgtcgtacggaaccgaaccgtaccgggtacccttaagtttttaactaacgttgtacggtaaccggtaaggtagtttacggtttaacgggtcggttacggtttcggtttttaccg

SEQ ID NO: 348983 - DNA, 539 bp, Homo sapiens
  misc_feature: GZ8MTXP02I2GXD.45.37.D04.1.454.CMB.2.raw
  modified_base (279)..(279): a, c, t, g, unknown or other
  misc_feature (279)..(279): n is a, c, g, or t
  modified_base (358)..(358): a, c, t, g, unknown or other
  misc_feature (358)..(358): n is a, c, g, or t
  modified_base (422)..(422): a, c, t, g, unknown or other
  misc_feature (422)..(422): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagccgtggggcctcagtgaaggtctcctgcaaggcttctggctacaccttcaccggcgactatcnccactgggtgcgacaggcccctggacaagggctggagtggagtgggatggatcaacccctaacagtggtgcacgaactntgacacagtaagttcgagggcagggtcaccatacgaccgaggacacgtcatcagcacagcctanactggagtcagagcagactagacatctacgacgacgaccggtactactttactaaccgtgttacggaaccgtaggtacgttacggtttaccggtcggtacgtttggtttttacccgg

SEQ ID NO: 348984 - DNA, 526 bp, Homo sapiens
  misc_feature: GZ8MTXP02HXCUO.45.37.D04.1.454.CMB.2.raw
  modified_base (343)..(343): a, c, t, g, unknown or other
  misc_feature (343)..(343): n is a, c, g, or t
  modified_base (364)..(364): a, c, t, g, unknown or other
  misc_feature (364)..(364): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctggggcctcagtgaaggtctcctgcaaggcttctggctacaccttcaccggcgactatctccactgggtgcgacgacggcccctggacaagggcttgagtggatgggatggatcaaccccctaanaacgtggtggacaacaaactntgacacagtaagtttcagggcagggtcaccgatcgacagggacacgtccatcagcacacgcctacatggagctagagcaagactagacatactcgacgacacggcctaagtttactactgtgaacgtaggtagttcggtttacggtggtcgtttggtttccg

SEQ ID NO: 348985 - DNA, 522 bp, Homo sapiens
  misc_feature: GZ8MTXP02IZ7T9.45.37.D04.1.454.CMB.2.raw
  modified_base (356)..(356): a, c, t, g, unknown or other
  misc_feature (356)..(356): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctgaggtgaggaagcctggggcctcagtgaaggtctcctgcaaggcttctggctacaccttcaccggcgactatctccactgggtgcgacaggccccctggacaagggcttgagtggatgggatggatcaacccctacatggtggcacaaactntgcacagtaagtttcaggggcaggggtcaccatgaccagggacacgtccatcagcacacgcctacatggagctgagcagactgacatctacgacgacacggacctatttacttacgtgtagcggaggtacgttcggtttaccggtcggtcgtttcggtttttaccg

SEQ ID NO: 348986 - DNA, 539 bp, Homo sapiens
  misc_feature: GZ8MTXP02I4MV4.45.37.D04.1.454.CMB.2.raw
  modified_base (334)..(334): a, c, t, g, unknown or other
  misc_feature (334)..(334): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
  modified_base (411)..(411): a, c, t, g, unknown or other
  misc_feature (411)..(411): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagctggggcctcagtgagtctcctgcagcttctggctacaccttcaccggcgactatcctccacgtgggtgcgacacggcccctggacagggcttgagtggatggatggatcaacccctaanatggtagcaacaaactntnacacagaagtttcgagggcacgggtcaccgagtagaccgagggacacgacatcagcanacgacctaacagtggagcgtagagacagactagacatcgacgaccgaacgaccggtaccttaatttacttacgtcgtaggaacgtaggtacgtttcgggttacggtcggttcgtttcggttttaccgg

SEQ ID NO: 348987 - DNA, 538 bp, Homo sapiens
  misc_feature: GZ8MTXP02GZW9U.45.37.D04.1.454.CMB.2.raw
  modified_base (223)..(223): a, c, t, g, unknown or other
  misc_feature (223)..(223): n is a, c, g, or t
  modified_base (356)..(356): a, c, t, g, unknown or other
  misc_feature (356)..(356): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagctggggcctnagtgaggtctctgcaaggcttctggctacaccttcaccggcgactatctccactgggtgcgacacggcccctggacaagggcttgagtggatggggatggatcaaccccctaacaagtggtggacacaaactntgcacagtaagtttcgagggcagggtcaccatcgacagggacacgtcatcagcaactagaactacatgggagctgagcagactgacagtctacgacgacaccggtacctaatttacgttaaccgtgttcgaaccggtaggtacgttacgggtttaccggtggttcgtttcggtttttcccgg

SEQ ID NO: 348988 - DNA, 579 bp, Homo sapiens
  misc_feature: GZ8MTXP02IKBJI.45.37.D04.1.454.CMB.2.raw
  modified_base (251)..(251): a, c, t, g, unknown or other
  misc_feature (251)..(251): n is a, c, g, or t
  modified_base (261)..(261): a, c, t, g, unknown or other
  misc_feature (261)..(261): n is a, c, g, or t
  modified_base (264)..(264): a, c, t, g, unknown or other
  misc_feature (264)..(264): n is a, c, g, or t
  modified_base (266)..(267): a, c, t, g, unknown or other
  misc_feature (266)..(267): n is a, c, g, or t
  modified_base (269)..(269): a, c, t, g, unknown or other
  misc_feature (269)..(269): n is a, c, g, or t
  modified_base (276)..(276): a, c, t, g, unknown or other
  misc_feature (276)..(276): n is a, c, g, or t
  modified_base (282)..(282): a, c, t, g, unknown or other
  misc_feature (282)..(282): n is a, c, g, or t
  modified_base (332)..(332): a, c, t, g, unknown or other
  misc_feature (332)..(332): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaagcttnggctacactncgncnncncactggngcgacncgcccctggacaagggctgagtggatgggatggactcaacccccctaaanagtggacgacaactaactgtgacaacgtagtacgttcgagggcgaggtcacgagtacgacgacggacgacgtacacacacgacacacgacctacgagtaggacgacgagacgacgacgacgtacgactactacgtacgaaccgaaccgaaccggtaccgttaacgtttacgtttacgttacggtacggtaacggtaacggttacggtttacggtttaccgggttcggtttcggtttcggttttccgg

SEQ ID NO: 348989 - DNA, 511 bp, Homo sapiens
  misc_feature: GZ8MTXP02HI4Z5.45.37.D04.1.454.CMB.2.raw
  modified_base (360)..(360): a, c, t, g, unknown or other
  misc_feature (360)..(360): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacaccttcaccggcgactatctccactgggtgcgacaggccccctggacaagggcttgagtggatgggatggatcaaccccctaacaagtggtaggcaacaaactntgcacagaagtttcagggcagggtcaccatgaccagggacacgtcatcagcacagcctacatggagctgatcagactgacatctagacgacacggcctaatttactactgtgcgtaggtagttacggtttacggtggtctttggttttccg

SEQ ID NO: 348990 - DNA, 532 bp, Homo sapiens
  misc_feature: GZ8MTXP02I2T5R.45.37.D04.1.454.CMB.2.raw
  modified_base (361)..(361): a, c, t, g, unknown or other
  misc_feature (361)..(361): n is a, c, g, or t
  modified_base (493)..(493): a, c, t, g, unknown or other
  misc_feature (493)..(493): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatctccactgggtgcgacacggcccctggacagggctgagtggatgggatggatccaacccctaacaagtggtcggcaaccaaactntgcacgagaagtttacgagggcaaggggtcaacccagtacggaccaggggaacaccggttccaatcaagcaacagcctacatggagctgagctagactgacatctacgacgacacggtccatttactactgngcgaggtatacggtttacggtggacttcgggtttttacc

SEQ ID NO: 348991 - DNA, 524 bp, Homo sapiens
  misc_feature: GZ8MTXP02F0C85.45.37.D04.1.454.CMB.2.raw
  modified_base (447)..(447): a, c, t, g, unknown or other
  misc_feature (447)..(447): n is a, c, g, or t
  modified_base (459)..(459): a, c, t, g, unknown or other
  misc_feature (459)..(459): n is a, c, g, or t
  modified_base (466)..(466): a, c, t, g, unknown or other
  misc_feature (466)..(466): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacaccttcaccggcgactatctccactgggtgcgacacggcccctggacaagggcttgagtggatggggatggatcccaaccctaacaagtggtggacaacaactatgacacgagtaacgtttcgagggacaggggtaccacagtcgaaccgaggggaccacgtccatcagacacacgcctacgatgggancgtgagcagacngacatcngacgacacggacctattactactgtgcgtacgtacgtcgtttacggtcgtcgtttcgg

SEQ ID NO: 348992 - DNA, 559 bp, Homo sapiens
  misc_feature: GZ8MTXP02G5RQW.45.37.D04.1.454.CMB.2.raw
  modified_base (364)..(364): a, c, t, g, unknown or other
  misc_feature (364)..(364): n is a, c, g, or t
  modified_base (417)..(417): a, c, t, g, unknown or other
  misc_feature (417)..(417): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctaccaaacaataaagaaactacttaagcttggtaccagcaagaaaccaggtcaagcctacctaaagctgctcatttactggcatccgaccgggaatccggggtcccctgaccgatcagtgcngcgggtctgggacagatttcactctcaccatcagcagcctgcaggctagaaantagtggactagtttatgtactgtacaagactaattaattaattaattacttaccttaccgttaccgttaccggtacccgtacggtaaccgtaaacgtaacgtaagtaactaacgtaaaacgtaacgtacgtacgtacgtacg

SEQ ID NO: 348993 - DNA, 594 bp, Homo sapiens
  misc_feature: GZ8MTXP02H8UI9.45.37.D04.1.454.CMB.2.raw
  modified_base (483)..(483): a, c, t, g, unknown or other
  misc_feature (483)..(483): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttttagacagctaccaacaataaagaactaacttagcttaggtaccagacaacgaaaccaggtacacgccctacctaagctgctctaatttacgtgggcagtccgtaacccgggaacgtcccggggtcccccctagaccgtatcgaggtcggcgcggcggggtcgtcgggactagtactttcacctctaccaactactcaagccacgcccgtgacgagtcgaagaagtgtggtacgtagttagtttcgtntagtctagactattaattatttataacttccttccgtaccgttacgtcccggtacgtaacgaacgtaacgtagtaactacaaaacgtaacgtagttacggacgtacgaccg

SEQ ID NO: 348994 - DNA, 524 bp, Homo sapiens
  misc_feature: GZ8MTXP02HHKP0.45.37.D04.1.454.CMB.2.raw
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaggtctcctgcaaggcttctggctacaccttcaccggcgactatcctccacgtgggtgcgacacggcccctggacagggcttgagtggatgggatggatcaacccctaanaagtggtgacaacaaactntgacaacgagtaagtttcgagggcagggtcaccgatcgaccgagggacacgtcatcagcacacgcctacagtggagctgacgcagactgacatcgtagacgacacggtacctatttactacgtgtgcgaggtacgttcggttaccggtcggtcgttcggttttcg

SEQ ID NO: 348995 - DNA, 519 bp, Homo sapiens
  misc_feature: GZ8MTXP02GGNX7.45.37.D04.1.454.CMB.2.raw
  modified_base (290)..(290): a, c, t, g, unknown or other
  misc_feature (290)..(290): n is a, c, g, or t
  modified_base (361)..(361): a, c, t, g, unknown or other
  misc_feature (361)..(361): n is a, c, g, or t
  modified_base (430)..(430): a, c, t, g, unknown or other
  misc_feature (430)..(430): n is a, c, g, or t
  modified_base (507)..(507): a, c, t, g, unknown or other
  misc_feature (507)..(507): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccagggtgcagctggtgcagtctggggctgaggtgaggaagcctggggcctcagtgaaggtctcctgcaaggcttctggctacaccttcaccggcgactatctccactgggtncgacacggcccctggacaagggcttgagtggatgggatggatccaaaccctaacaatggtgacaacaactntagcaacagtaaagtttcagggacagggtcaccatgaccagggcacgtccatacagacacagaccctanagtaggagctagagcagactagacatcagacgacacggacctatttactactgtgacgaggacttggtttaaccggnggtcgttttcgg

SEQ ID NO: 348996 - DNA, 506 bp, Homo sapiens
  misc_feature: GZ8MTXP02GZHZP.45.37.D04.1.454.CMB.2.raw
  modified_base (357)..(357): a, c, t, g, unknown or other
  misc_feature (357)..(357): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctgaggtgaggaagcctggggcctcagtgaaggtctcctgcaaggcttctggctacaccttcaccggcgactatctccactgggtgcgacaggcccctggacaagggcttgagtggatgggatggatcaaccccctaacatggtgacacaaactntgcacagaagtttcagggcagggtcaccatcgaccagggacacgtcatcagcacagcctacatggagctgagcagactgacatctacgacgacacggcctagtttactactgtgcgaggacttcggttacggtggtcttcggttttccg

SEQ ID NO: 348997 - DNA, 635 bp, Homo sapiens
  misc_feature: GZ8MTXP02IDX2C.45.37.D04.1.454.CMB.2.raw
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagccccactccccaggtgcagctggtgcagtctggggctgaggtgaggaagccgtggggcctcagtgaaggtctcctgcaaggcttctggctacaccttcaccggcgactatctccacgtgggtgcgacaggccccctggacaagggctttggagtggagtgggatggactaccaaaccctaaccgaaagtcgggtaggaccaacgtaaaaactagtgacaaacaagtaagtttcgagggcacgggtacaccatacgaccagggaccacgtccatacagacaacacgtacctacagtacggagccgtagagaccgtaaggactacggaacctagtacgtaacgaaccgaaccgacccgggtaccttaaacgttttaactttaaccgtggttacgtacggaagggttacgtttacgggtttaaccccgggttgggttacccgtttcgggttttttacccgttttaacgggg

SEQ ID NO: 348998 - DNA, 521 bp, Homo sapiens
  misc_feature: GZ8MTXP02IPBQD.45.37.D04.1.454.CMB.2.raw
  modified_base (313)..(313): a, c, t, g, unknown or other
  misc_feature (313)..(313): n is a, c, g, or t
  modified_base (357)..(357): a, c, t, g, unknown or other
  misc_feature (357)..(357): n is a, c, g, or t
  modified_base (435)..(435): a, c, t, g, unknown or other
  misc_feature (435)..(435): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctaccaacaataagaactacttagcttggtaccagcaagaaccaggtcagcctcctaagctgctcatttacnggcatcgtacccggaatccggggtcccctgaccgattcagtgcnggcgggtctgggacagtatttcactctcacatcagcagcctgcaggctagaagatggtggtctagtttatgctgtacngacaattatattattacttcctacgtacgtttcggccctcggaacctaagtaggaatactacgaaaacgtacgtagtcggactacg

SEQ ID NO: 348999 - DNA, 531 bp, Homo sapiens
  misc_feature: GZ8MTXP02HXUBU.45.37.D04.1.454.CMB.2.raw
  modified_base (363)..(363): a, c, t, g, unknown or other
  misc_feature (363)..(363): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggctgaggtgaggaagcctggggcctcagtgaaggtctcctgcaaggcttctggctacaccttcaccggcgactatcctccacgtgggtgcgacacggcccctaggacaagggtcttggagtggatgggatggatcaacccctaacaagtggtgacaacaaactntgacacagtaagttcgagggcagggtcaccgatcgacgagggacacgtcatcagcacagcctacagtggagcgtagacgacgagactaggactatcgtagaccacgaccgcttaatttactactgtagcggtagtacttcggttaccggtgtcgtttcggttttaccg

SEQ ID NO: 349000 - DNA, 572 bp, Homo sapiens
  misc_feature: GZ8MTXP02F8SPM.45.37.D04.1.454.CMB.2.raw
  modified_base (343)..(343): a, c, t, g, unknown or other
  misc_feature (343)..(343): n is a, c, g, or t
  modified_base (441)..(441): a, c, t, g, unknown or other
  misc_feature (441)..(441): n is a, c, g, or t
  modified_base (472)..(472): a, c, t, g, unknown or other
  misc_feature (472)..(472): n is a, c, g, or t
tcagacgcgatcgacacgaccggtgctcgatttagtagcatactgttgggtttggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccacataccaactgacaacgtccagccagtagttgtttagacagcctaccaaactaaataaagaacttacgttagtcgttacggtaaccagacaaacgaaaccgtaggtcacgcctactaagctcgctactatttacgnggctactaccgtaccggaatccgtccgggtccctacgaccgtattcgaggtcgcgaggcggtcgtggacagtacttcactctccaacatcagcacgcngcagtctaagaaagtgtggtgacttagtttncgtgtgacatataattattattacttacttcctaccgttacttccggaccgtacggaactaaggtcgtaactacgtaacgtaacgtacgtcggtacgtcg

SEQ ID NO: 349001 - DNA, 532 bp, Homo sapiens
  misc_feature: GZ8MTXP02HBZ6D.45.37.D04.1.454.CMB.2.raw
  modified_base (226)..(226): a, c, t, g, unknown or other
  misc_feature (226)..(226): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctnagtgaaggtctcctgcaaggcttctggctacaccttcaccggcgactatctccactgggtgcgacacggcccctggacaagggcttgagtggatgggatggatcgaaacccctaacaagtggtaggacaacaaaactatcgacacaagtaagtttcgaaggggcaaggggtacaacccatcgaacccgaggggacacggtacccaatcacgcaacagacctacagtggagactgagacagactgacatctcgacgacacggcctatttactactgtgcgagattcgttaccgtggtcttgtttccg

SEQ ID NO: 349002 - DNA, 503 bp, Homo sapiens
  misc_feature: GZ8MTXP02JD8F8.45.37.D04.1.454.CMB.2.raw
  modified_base (250)..(250): a, c, t, g, unknown or other
  misc_feature (250)..(250): n is a, c, g, or t
  modified_base (316)..(316): a, c, t, g, unknown or other
  misc_feature (316)..(316): n is a, c, g, or t
  modified_base (350)..(350): a, c, t, g, unknown or other
  misc_feature (350)..(350): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagctggggctcagtgaggtctctgcagctctggctacnccttcaccggcgactatctccactgggtgcgacaggccccctggacaagggcttgagtggatgggntggatcaaccccctaacaatggtggcaacaactntgacacagaagtttcagggcagggtcacatgacagggacacgtccatcagcacagcctacatcggagctagacgcaggacngacanctcgacgacaccggtccagtttactacgtgtgcggagacttggttaccggtgtccgttggttttccg

SEQ ID NO: 349003 - DNA, 494 bp, Homo sapiens
  misc_feature: GZ8MTXP02HTMN2.45.37.D04.1.454.CMB.2.raw
  modified_base (350)..(350): a, c, t, g, unknown or other
  misc_feature (350)..(350): n is a, c, g, or t
  modified_base (424)..(424): a, c, t, g, unknown or other
  misc_feature (424)..(424): n is a, c, g, or t
  modified_base (440)..(440): a, c, t, g, unknown or other
  misc_feature (440)..(440): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatcctccactgggtgcgacaggcccctggacaagggcttgagtggatggatggatccaacctacaatggtagcanaactatgacacagaagtttcagggcagggtcacatcgacgagggacacgtcatcagcacagcctacatggagcngagcagactgacatcngacacacggcctagttacttactgtgcgagtactgtttaccggtggtctttcgg

SEQ ID NO: 349004 - DNA, 522 bp, Homo sapiens
  misc_feature: GZ8MTXP02IX0H8.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaggtctcctgcaaggcttctggctacaccttcaccggcgactatctccactgggtgcgacacggcccctggacaagggcttgagtggatgggatggatcaacccctacatggtgcacaactatgcacagtaagtttcgaggggacagggtcaccatgaccagggacacgtcatcagcacagcctaacatggagctgagcagactgacatctgacgacgacggacctaattttacttacgtgttagccgtaaggtacgttacggtttaccggtcggttccgttcggtttttccg

SEQ ID NO: 349005 - DNA, 520 bp, Homo sapiens
  misc_feature: GZ8MTXP02HD6QL.45.37.D04.1.454.CMB.2.raw
  modified_base (359)..(359): a, c, t, g, unknown or other
  misc_feature (359)..(359): n is a, c, g, or t
  modified_base (411)..(412): a, c, t, g, unknown or other
  misc_feature (411)..(412): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggccccctgaacaagggcttgagtggatgggatggatcaaccccctaacaatggtggcacaaactntgcacagaagttcagggcagggtcaccatgacagggacacgtcatcagcacnncctacatggagctgagcacgactgaacatactacgacgacacggacctagtttactacgtgttagcgtaggtacgttcggtttaccggtcggtacttcggttttcccg

SEQ ID NO: 349006 - DNA, 622 bp, Homo sapiens
  misc_feature: GZ8MTXP02JQ5FV.45.37.D04.1.454.CMB.2.raw
  modified_base (339)..(339): a, c, t, g, unknown or other
  misc_feature (339)..(339): n is a, c, g, or t
  modified_base (397)..(397): a, c, t, g, unknown or other
  misc_feature (397)..(397): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggcctgtgtctcgtgggcgaggacggccaccataccaactgacaacgtccacgccagtagttagtttagacagcctaccaaacaataaagaactacttagtcttacggtaaccagacaacgaaaccaggtcacgcctacctaagctgctactatttacgnggactacgtccgtaaccggactccgtccggtccctacgtaccgtattcgagtcgacgnggtcggtcgtaggggactagtactttcgactctaccacatcacgcacgcctagccgagctaggaagtagttgggtcgtacgttaggtttaatcgtcttcgtacgactaattaatttattaatttactaacgtttccctaccggttaaccgttttccggacccgttaacgggtaacctaaaggtaaggtaactaacgtaaccgaaaacgtcgtacggtagtacccg

SEQ ID NO: 349007 - DNA, 528 bp, Homo sapiens
  misc_feature: GZ8MTXP02I96DP.45.37.D04.1.454.CMB.2.raw
  modified_base (312)..(312): a, c, t, g, unknown or other
  misc_feature (312)..(312): n is a, c, g, or t
  modified_base (357)..(357): a, c, t, g, unknown or other
  misc_feature (357)..(357): n is a, c, g, or t
  modified_base (415)..(415): a, c, t, g, unknown or other
  misc_feature (415)..(415): n is a, c, g, or t
  modified_base (436)..(436): a, c, t, g, unknown or other
  misc_feature (436)..(436): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtaccagcagaaaccaggtcagcctactaagctgctcatttacnggcatcgtacccggaatccggggtcccctgaccgattcagtggcnggcgggtctgggacagatttcactctcaccatcagcagccctgcaggctagaagatgngctagtttatgctgtacagtntaattattatacttacttccctccgtactttccggacccttgggaaaccctaaaggtggtaactagtacaaaacgtactaggtacggctacg

SEQ ID NO: 349008 - DNA, 671 bp, Homo sapiens
  misc_feature: GZ8MTXP02JD4NL.45.37.D04.1.454.CMB.2.raw
  modified_base (375)..(375): a, c, t, g, unknown or other
  misc_feature (375)..(375): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctcctgcaggcttctggctacaccttcaccggcgactatcctccacgtgggtgcgacacggcccctggacgaagggcttggagtggagtgggatggactaccaaaccccctaagaagtggtacggacaaacaaactntcgacaacgtagtaagtttcgacgggcgacggggtccaaccgtagtacggaacccgaaggggaccaccggtaccaacgtaccgacgaccaaaccgaacggtacccttaacgacgttacgggaacggtccgtagggaacggacgtaaacggactacggaacctacgtaccggtacggaaacccggaaccgtaacccgggtacccttaaaggtttttaactaaccgttgtacgggtaaccggaaggttacggtttacgggtttaccgggttcggttccggtttacgggtttttcccgg

SEQ ID NO: 349009 - DNA, 508 bp, Homo sapiens
  misc_feature: GZ8MTXP02H0QOV.45.37.D04.1.454.CMB.2.raw
  modified_base (361)..(361): a, c, t, g, unknown or other
  misc_feature (361)..(361): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctggggcctcagtgaaggtctcctgcaaggcttctggctacaccttcaccggcgactatctccactgggtgcgacaggccccctggacaagggcttgagtggatgggatggatcaaccccctaacaatggtggcaacgaaactntgcacagaagtttcagggcagggtcaccatgaccagggacacgtcatcagcacagcctacagtggagctagagacagactgacatctgacgacacggccagtttactactgtgcgaggtatcggttaccggtggtctttggtttccg

SEQ ID NO: 349010 - DNA, 510 bp, Homo sapiens
  misc_feature: GZ8MTXP02GFULN.45.37.D04.1.454.CMB.2.raw
  modified_base (359)..(359): a, c, t, g, unknown or other
  misc_feature (359)..(359): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctgggggcctcagtgaaggtctcctgcaaggcttctggctacaccttcaccggcgactatctccactgggtgcgacaggccccctggacaagggcttgagtggatgggatggatcaaccccctaacaatggtggcacaaactntgcacagaagtttcagggcagggtcaccatgaccagggacacgtcatcagcacagcctacatggagctgagcagactgacatctcgacgacacggacctatttactactgtagcgtaggattcggtttaccggtggtcgttcggttttccg

SEQ ID NO: 349011 - DNA, 539 bp, Homo sapiens
  misc_feature: GZ8MTXP02IITMS.45.37.D04.1.454.CMB.2.raw
  modified_base (364)..(364): a, c, t, g, unknown or other
  misc_feature (364)..(364): n is a, c, g, or t
  modified_base (399)..(399): a, c, t, g, unknown or other
  misc_feature (399)..(399): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttcgtggctacaccttcaccggcgactatcctccacgtgggtgcgacgacggcccctggacaagggcttgagtggatgggatggatcaacccctaacagtggtcgcaacaaactntgacaacgagtaagttcgagggcagggtcacctancgacaggacacgtcatcagcagacgactacagtggagctagacgcagactgacacgtctacgacgacgacggtacctaatttacgtaactgtacgcggacgtagttacggtttacggtcggttcgtttacggtttttccg

SEQ ID NO: 349012 - DNA, 611 bp, Homo sapiens
  misc_feature: GZ8MTXP02ILYYC.45.37.D04.1.454.CMB.2.raw
  modified_base (260)..(260): a, c, t, g, unknown or other
  misc_feature (260)..(260): n is a, c, g, or t
  modified_base (271)..(271): a, c, t, g, unknown or other
  misc_feature (271)..(271): n is a, c, g, or t
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaaggtctcctgcaggcttctggctacnccttcaccggnactatcctccacgtgggtgcgacgacggccccgtaggacgaagggtcttggagtggagtgggatggaataccaaacccctaanaagtggtacgacaacaaactntgacacgagtaacgtttcgagggcgagggtcacctagcgaccgaagggacacgtcatcagcaacgacgacctacgagtcgggactagacgacgacgacgtacgactaacgtcgtacgtaacgacgaacggtaccgtttaagttaactttacgttacggttacgtacgggtaacggttacggtttaacggttttaccgggttacgggtccgttttcggtttttcggtttttaccggg

SEQ ID NO: 349013 - DNA, 491 bp, Homo sapiens
  misc_feature: GZ8MTXP02IQNB7.45.37.D04.1.454.CMB.2.raw
  modified_base (341)..(341): a, c, t, g, unknown or other
  misc_feature (341)..(341): n is a, c, g, or t
  modified_base (439)..(439): a, c, t, g, unknown or other
  misc_feature (439)..(439): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatgggatggatccgaaccctanaatggtggcacaactatgcacagaagtttcagggcagggtcacatgacagggcacgtcatcagcacagcctacatggagctgagcagactgacagtcngacgacgacggctatttactactgtgcgagtactgtttaccggtgctttcgg

SEQ ID NO: 349014 - DNA, 521 bp, Homo sapiens
  misc_feature: GZ8MTXP02GNTZ7.45.37.D04.1.454.CMB.2.raw
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (350)..(351): a, c, t, g, unknown or other
  misc_feature (350)..(351): n is a, c, g, or t
  modified_base (355)..(355): a, c, t, g, unknown or other
  misc_feature (355)..(355): n is a, c, g, or t
  modified_base (404)..(404): a, c, t, g, unknown or other
  misc_feature (404)..(404): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaggctctggctacaccttcaccggcgactatctccactgggtgcgacaggcccctggacagggcttgagtggatgggatggatcaacccctaanatggngcacaactnnacanagtaagttcgagggcagggtcaccagtcgacgagggacacgtcaatcancacacgcctaacagtaggagctagacgcagactgacatcgtacgacgacgacggctaatttactactgtacgaacgtaggtacgttcggtttaccggtggtcgtttcggtttttccg

SEQ ID NO: 349015 - DNA, 508 bp, Homo sapiens
  misc_feature: GZ8MTXP02IOJQ7.45.37.D04.1.454.CMB.2.raw
  modified_base (445)..(445): a, c, t, g, unknown or other
  misc_feature (445)..(445): n is a, c, g, or t
  modified_base (472)..(472): a, c, t, g, unknown or other
  misc_feature (472)..(472): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaggtctcctgcaaggcttctggctacaccttcaccggcgacctatcctccactgggtgcgacacggcccctggacaagggcttgagtggatggggatggatcaaccccctaacaatggtggcacaaactatgcaacagaagtttcagggcagggtcacatgaccagggacacgtcatcagcacagcctacgatcgggagactgagcagactgacngtctgacgactacggccatttattacngttagcgaggtatggtttaccggtgcgttgtttccg

SEQ ID NO: 349016 - DNA, 525 bp, Homo sapiens
  misc_feature: GZ8MTXP02IVYGR.45.37.D04.1.454.CMB.2.raw
  modified_base (358)..(358): a, c, t, g, unknown or other
  misc_feature (358)..(358): n is a, c, g, or t
  modified_base (426)..(426): a, c, t, g, unknown or other
  misc_feature (426)..(426): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacacggcccctggacaagggcttgagtggatggggatggatcaacccctaacatggtggacacaaactntgcacagaagttcgagggcagggtcaccatgacaggacacgtcatcagcacagcctacagtggagtcngagacagactagacatcgtacgacgacacggacctaagtttactacgtgtagaacgtaggtacgttacggtttaccggtcggtcgtttcggtttttccg

SEQ ID NO: 349017 - DNA, 655 bp, Homo sapiens
  misc_feature: GZ8MTXP02JJ88Z.45.37.D04.1.454.CMB.2.raw
  modified_base (225)..(225): a, c, t, g, unknown or other
  misc_feature (225)..(225): n is a, c, g, or t
  modified_base (248)..(248): a, c, t, g, unknown or other
  misc_feature (248)..(248): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctggaggtgaggagccgtgggctnagtgaggtctcctgcaggcttcnggctacaccttcaccggcactactccccagtgggtcgcgacgacggcccctggacgaagggcttggaggtggagtgggatggactaccgaaacctaacgagtgggtacgacaacaaactatcggacaacgtaaggtaacgtttcggaaggggtcgaacggggtaccaaccgtaagtacggaacccgaacggggaaccctaccggttacccaaacgtaccgaaacgacccaaaccgaacggtaccccttaaacgacgttagggaacgcgtagaacgacgaagacgtacgactacgtacgacgaaccgacgaccggtaccttaagtttaacgttaccgtcggtaggtacggtaaggttacgtttaccgggtttaccgggtggttccgtttcggtttaccgttttacggg

SEQ ID NO: 349018 - DNA, 510 bp, Homo sapiens
  misc_feature: GZ8MTXP02F86KE.45.37.D04.1.454.CMB.2.raw
  modified_base (258)..(258): a, c, t, g, unknown or other
  misc_feature (258)..(258): n is a, c, g, or t
  modified_base (287)..(287): a, c, t, g, unknown or other
  misc_feature (287)..(287): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
  modified_base (449)..(449): a, c, t, g, unknown or other
  misc_feature (449)..(449): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacnccttcaccggcgactatctccactgggtncgacaggcccatggacaagggcttgagtggatgggatggatccaaccctaacaatggtggacaacaactatgacacagtaagtttcgagggcagggtcacatgaccgagggaccacgtaccatcagcacagcctacataggatcngancgagctgacatcgngacacacggctatttacgtctagtgacgaggtacttcggtttaccggtggtcgttttcggg

SEQ ID NO: 349019 - DNA, 522 bp, Homo sapiens
  misc_feature: GZ8MTXP02HXFV0.45.37.D04.1.454.CMB.2.raw
  modified_base (363)..(363): a, c, t, g, unknown or other
  misc_feature (363)..(363): n is a, c, g, or t
  modified_base (413)..(413): a, c, t, g, unknown or other
  misc_feature (413)..(413): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactccccaggtgcagctggtgcagtctggggctgaggtgaggaagcctggggcctcagtgaaggtctcctgcaaggcttctgggctacaccttcaccggcgactatctccactggtgcgacaggcccctggacaagggcttgagtggatggggatggatcaaccccctaacaactggtggacacaaaactntgacacagaatttcgagggtcagggtcacatgacaggacacgtccatcancgacacgcctacagtggagctgagcaggactgacaatctacgacgacacggccagtttactactgttgaacgtaggacttcggttacggtcggtcgttacggttttccg

SEQ ID NO: 349020 - DNA, 565 bp, Homo sapiens
  misc_feature: GZ8MTXP02IVL25.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggctcagtgaggtctctgcaggctctggctacacttcaccggcgactatcctccactgggtgcgacaggcccctggacaaggctgagtggatgggatggataccaacccctacaagtggtaggacacgtaaactgtgacaacagtaagttcgagggcgagggtcaccatacgaccgagggacacgtacatcgagcacgacgacctacagtaggacgcgtagagacgagactagacactcgtacgaccgacgaccggtacctaattttacgttaaccgttggtacggtaaccggtaggtaacgtttcgggtttaacccgggttggtaccgtttcgggttttttacccg

SEQ ID NO: 349021 - DNA, 523 bp, Homo sapiens
  misc_feature: GZ8MTXP02IVNEX.45.37.D04.1.454.CMB.2.raw
tcagacgcgatcgacacgaccggtgctcgatttagtagcatactgttgggtttgggggcatcacccagcaaccacatctgtcctctagagaatccccctgagagctccgttcctcaccatggactggacctgtaggatcctcttcttggtggcagcagccacaagagccccactccccaggtgcagctggtgcagtctgggggctgaggtgaggaagcctgggggcctcagtgaaggtctcctgcaaggcttctggctacaccttcaccggcgactatctccactggggtgcgacaggccccctggacaaggggcttgagtgggatggggatgggatcaaccctaacaatggtggcacaaaactatgcacagaagtttcaggggcagggtcacatgaccagggacacgtccatcagcacagcctacatgagctgacgcaggactagacatctgacgacacggcctaatttactactgtgacgaaggtacttcggtttaccggtggtcttggtttcccttttgg

SEQ ID NO: 349022 - DNA, 522 bp, Homo sapiens
  misc_feature: GZ8MTXP02IPL08.45.37.D04.1.454.CMB.2.raw
  modified_base (342)..(342): a, c, t, g, unknown or other
  misc_feature (342)..(342): n is a, c, g, or t
  modified_base (361)..(361): a, c, t, g, unknown or other
  misc_feature (361)..(361): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (506)..(506): a, c, t, g, unknown or other
  misc_feature (506)..(506): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctgggggcctcagtgaaggtctcctgcaaggcttctggctacaccttcaccggcgactatctccactgggtgcgacaggcccctggacaagggcttgagtggatgggatggatcaaaccccctaanaactggtggcaacaaactntgacaacagtaagtttcagggtcagggtcacatgaccagggacacgtcatcagcacagcctaacntgganctgagcagactgaccatctacgacgacacggacctaatttactaactgtacgaacgaggtactcggtttaccggnggtcttcggttttccg

SEQ ID NO: 349023 - DNA, 526 bp, Homo sapiens
  misc_feature: GZ8MTXP02I62AR.45.37.D04.1.454.CMB.2.raw
  modified_base (312)..(312): a, c, t, g, unknown or other
  misc_feature (312)..(312): n is a, c, g, or t
  modified_base (357)..(357): a, c, t, g, unknown or other
  misc_feature (357)..(357): n is a, c, g, or t
  modified_base (413)..(413): a, c, t, g, unknown or other
  misc_feature (413)..(413): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtaccagcagaaaccaggtcagcctcctaagctgctcatttacnggcatccgtaccgggatccggggtcccctgaccgtatcagtggcnggcgggtctgggacagtatttcactctcaccatcagcagcctgcaggctagaaagntgtggctagtttatcgactgtacagtcaaattattaattatactttcctaccgtacgtttcggcccttagggaaccctaagtgaatacgtacaaacgtactaggtcgactacg

SEQ ID NO: 349024 - DNA, 513 bp, Homo sapiens
  misc_feature: GZ8MTXP02G2D6F.45.37.D04.1.454.CMB.2.raw
  modified_base (360)..(360): a, c, t, g, unknown or other
  misc_feature (360)..(360): n is a, c, g, or t
  modified_base (432)..(432): a, c, t, g, unknown or other
  misc_feature (432)..(432): n is a, c, g, or t
  modified_base (488)..(488): a, c, t, g, unknown or other
  misc_feature (488)..(488): n is a, c, g, or t
  modified_base (498)..(498): a, c, t, g, unknown or other
  misc_feature (498)..(498): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaggtctcctgcaaggcttctggctacaccttcaccggcgactatcctccactgggtgcgacacggcccctggacaagggcttggagtggatgggatggatcaaccccctacaagtggtggcacgaaactntgcacagtaagtttcgagggcagggtcaccatcgacagggacacggtccagtcagcacagcctacgatggancctgagcgagactgacagtcacgacgacacggacctatttactactgtgcgtagtntcggttacgnggtcgtggttttccg

SEQ ID NO: 349025 - DNA, 605 bp, Homo sapiens
  misc_feature: GZ8MTXP02I2NWM.45.37.D04.1.454.CMB.2.raw
  modified_base (366)..(366): a, c, t, g, unknown or other
  misc_feature (366)..(366): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtatggggctgaggtgaggaagccgtggggcctcagtgaggtctcctgcaaggcttctggctacaccttcaccggcgactatctccacgtgggtgcgacacggcccctggacgaagggcttgagtggagtgggatggatccaaccccctaacaagtggtggacaacaaactntgcacagaagtttcgagggcagggtcacatagaccgaggacacgtccatcagcacacgacctacagtcggacgtctacggagacgaggactaggaactactcgtacgaccggaaccgaaccgggtacccttaaattttaacgttaacgttacggttacggtaaccggtaagggttaacgtttacggggttttaacccgggttacgggggtttccgttttaccggggtttttttacccgg

SEQ ID NO: 349026 - DNA, 559 bp, Homo sapiens
  misc_feature: GZ8MTXP02G1NZQ.45.37.D04.1.454.CMB.2.raw
  modified_base (343)..(343): a, c, t, g, unknown or other
  misc_feature (343)..(343): n is a, c, g, or t
  modified_base (364)..(364): a, c, t, g, unknown or other
  misc_feature (364)..(364): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggagccgtggggcctcgagtgaaggtctcctgcaaggcttctggctacaccttcaccggcgactatctccactgggtgcgacgaggcccctggacagggcttggagtggattggatggatcaaccccctaanaagtggtaggcaacgaaactntgcaacgagtaagtttcgaggggtcaggggtccaacccgagtacgacccgaggggaaccaccggtaccatacagaccacacgacctacagtggagctagacgcgagactgacatcacgacgacgaccggcctaatttacgtactgtgaacgtaggtacgttacggtttacggtcggttcgttcggtttttacccg

SEQ ID NO: 349027 - DNA, 519 bp, Homo sapiens
  misc_feature: GZ8MTXP02JV1O9.45.37.D04.1.454.CMB.2.raw
  modified_base (355)..(355): a, c, t, g, unknown or other
  misc_feature (355)..(355): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggccccctggacaagggcttgagtggatgggatggatcaacccctacaatggtgcacaaactntgacacagaagtttcagggtcaggggtcacgatcgaccagggacacgtcagtcagcacagcctacagtggagcagagacagactagacatctacgacgacacggacctatttactactgtgcgaggtacgttcggtttaccggtggtccgttggtttttcccgg

SEQ ID NO: 349028 - DNA, 543 bp, Homo sapiens
  misc_feature: GZ8MTXP02HN7IY.45.37.D04.1.454.CMB.2.raw
  modified_base (362)..(362): a, c, t, g, unknown or other
  misc_feature (362)..(362): n is a, c, g, or t
  modified_base (404)..(404): a, c, t, g, unknown or other
  misc_feature (404)..(404): n is a, c, g, or t
  modified_base (476)..(476): a, c, t, g, unknown or other
  misc_feature (476)..(476): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggctcagtgaaggtctcctgcaaggcttctggctacaccttcaccggcgactatctccactgggtgcgacacggcccctggacaagggcttgagtggatgggatggatcaaaccccctaacaaagtggtggcaacaaaactntgacaacagtaagtttcgaaggggcaaggggtccaacccganacggaacccgaggggaccaccgtaccataccagcacagcctaacagtggagctagagaccagactgacatcngacgacacggcctaatttactactgtgaacgaggattcggttaccggtggtacgtttcggttttccg

SEQ ID NO: 349029 - DNA, 494 bp, Homo sapiens
  misc_feature: GZ8MTXP02JAWPS.45.37.D04.1.454.CMB.2.raw
  modified_base (288)..(288): a, c, t, g, unknown or other
  misc_feature (288)..(288): n is a, c, g, or t
  modified_base (356)..(356): a, c, t, g, unknown or other
  misc_feature (356)..(356): n is a, c, g, or t
  modified_base (375)..(375): a, c, t, g, unknown or other
  misc_feature (375)..(375): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (433)..(433): a, c, t, g, unknown or other
  misc_feature (433)..(433): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtncgacaggcccctggacaagggcttgagtggatgggatggatccaaccctaacaatggtggcacaactntgcacagaagtttcagggnagggtcacatgaccaggacacgtcatcagcacagcctacatgganctgancgagtacngacatctgacgacacggcctattactactgtcgcgaggtatgtttaccggtggtctttcgg

SEQ ID NO: 349030 - DNA, 551 bp, Homo sapiens
  misc_feature: GZ8MTXP02G4YQC.45.37.D04.1.454.CMB.2.raw
  modified_base (253)..(253): a, c, t, g, unknown or other
  misc_feature (253)..(253): n is a, c, g, or t
  modified_base (442)..(442): a, c, t, g, unknown or other
  misc_feature (442)..(442): n is a, c, g, or t
  modified_base (526)..(526): a, c, t, g, unknown or other
  misc_feature (526)..(526): n is a, c, g, or t
tcagacgcgatcgacacgaccggtgctcgatttagtagcatactgtttggggtttgggggcatcacccagcaaccacatctgtcctctagagaatccccctgagagctccgttcctcaccatggactggacctggaggatcctcttcttggtggcagcagccacaagagccccactccccaggtgcagctggtgcagtctggggctgaggtgaggagcctggggcctcagtgaaggtctcctgcaaggcttcnggctacaccttcaccggcgactatctccacgtgggtgcgacacggccccctggacaagggcttggagtggatgggatggataccaacctaacgaagtggtaggacaacgaaactatgacaacgagtaacgtttcgaggggcagggtcacgagtgaaccgagggacacgtccatcgagcacagccctaanagtggagctgacgcagactgacatcgacgacgacgacggacctatttacttacgtgtgtacggaaggtactacggtttaccggnggtccgttcggtttacgttttacgg

SEQ ID NO: 349031 - DNA, 520 bp, Homo sapiens
  misc_feature: GZ8MTXP02I8KY1.45.37.D04.1.454.CMB.2.raw
  modified_base (284)..(284): a, c, t, g, unknown or other
  misc_feature (284)..(284): n is a, c, g, or t
  modified_base (434)..(434): a, c, t, g, unknown or other
  misc_feature (434)..(434): n is a, c, g, or t
tcagacgcgatcgacacgaccggtgctcgatttagtagcatactgttgggtttggggagcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggagcctggggcctcagtgaggtctctgcaaggcttctggctacaccttcaccggcgactatctccactgggtncgacaggcccctggacaagggcttggagtggatgggatggatcaaccccctaacaagtggtggcaacaaactatgacacagaagtttcgagggcagggtcaccgatagaccagggacacgtccatcagcacacgacctacagtggagtcngagacaggactgacatctcgacgacacggctactttacgtactgtgaacgaggtacgttcggttaccggtgtcgttcgttttccgg

SEQ ID NO: 349032 - DNA, 505 bp, Homo sapiens
  misc_feature: GZ8MTXP02JA4ZW.45.37.D04.1.454.CMB.2.raw
  modified_base (340)..(340): a, c, t, g, unknown or other
  misc_feature (340)..(340): n is a, c, g, or t
  modified_base (356)..(356): a, c, t, g, unknown or other
  misc_feature (356)..(356): n is a, c, g, or t
  modified_base (410)..(410): a, c, t, g, unknown or other
  misc_feature (410)..(410): n is a, c, g, or t
  modified_base (486)..(486): a, c, t, g, unknown or other
  misc_feature (486)..(486): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtaccagcaagaaaccaggtcagcctcctaagctgctcatttactggcatctaccggaatccggggtccccngaccgattcagtggcnggcgggtctgggacagtatttcactctcaccatcagcagcctgcaggctagaanatgtggctagtttatgctgtcagacaattattatatacttcctccgtactttcgccgttggaacctaagtgaatanacaaacgactgacgctacg

SEQ ID NO: 349033 - DNA, 613 bp, Homo sapiens
  misc_feature: GZ8MTXP02GOCJJ.45.37.D04.1.454.CMB.2.raw
  modified_base (250)..(250): a, c, t, g, unknown or other
  misc_feature (250)..(250): n is a, c, g, or t
  modified_base (373)..(373): a, c, t, g, unknown or other
  misc_feature (373)..(373): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtgggcctcgagtgagtctcctgcgagctcnggctacaccttcgaccggcgactatcctccacgtgggtcgcgacgacggccccgtggaaccgaagggtcttaggagtggagtgggatggactacaacccctaacagtggtacgcaacaaactntgacaacgagtaagtttcgagggtacgacgggtcaccgatacggaaccgaggggaaccaccgtacagtccagccaaacgacgaccttaacgagtaggacgtcgaggaacgcgaaggaacctcggaactacgtacgtacggaaccgacgacccggtacttaacgttttacgtacgtaggttacggtaacggtacggtacgtttacgggttaccggtcggttcgttttcggtttttacccgg

SEQ ID NO: 349034 - DNA, 496 bp, Homo sapiens
  misc_feature: GZ8MTXP02GM8CE.45.37.D04.1.454.CMB.2.raw
  modified_base (285)..(285): a, c, t, g, unknown or other
  misc_feature (285)..(285): n is a, c, g, or t
tcagacgcgatcgacacgaccggtgctcgatttagtagcatactgttgggtttgggggcatcacccagcaaccacatctgtcctctagagaatcccctgagagctccgttccccaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtncgacaggcccctggacaagggcttgagtggatgggatggatcaacctaacaatggtgcacaaactatgcaacagaagtttcagggcagggtcaccatgacagggacacgtcatcagcacagcctacatggagctgagcagactgacatctgacgacacggcctatttatactgtgacgagtaatgttacggtcggctcggttcctttgacg

SEQ ID NO: 349035 - DNA, 613 bp, Homo sapiens
  misc_feature: GZ8MTXP02GJLBQ.45.37.D04.1.454.CMB.2.raw
  modified_base (366)..(366): a, c, t, g, unknown or other
  misc_feature (366)..(366): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatcctccactgggtgcgacgacggcccctggacaagggtcttggagtggagtgggatggactcaacccctaacaagtggtaggacaacaaactntacgacacgagtaagtttcgagggcagggtcaccagtacgacgagggacacgtacatcagacacgacgacctacagtaggaacgcgtagacgccgaagactacggaactacgttaccgtaggaacccgaacgtaacccggtacccttaaattttaacgtaaccgttggttacggaaccgggtaagggttaacgtttacggggtttaacccgggttcgggttaccggttttcgggttttttaccccgg

SEQ ID NO: 349036 - DNA, 582 bp, Homo sapiens
  misc_feature: GZ8MTXP02IX70F.45.37.D04.1.454.CMB.2.raw
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagcccactccccaggtgcagctggtgcagtctgggggctgaggtgaggaagcctggggcctcagtgaggtctcctgcaaggcttctggctacaccttcaccggcgactatctccactgggtgcgacaggccccctggacaaggggctggagtggatggggatgggatacaaacccctaacaagtggtaggacaacaaaacttatgacaacaagtaacgtttcgaagggcaggggtccaaccgtagtacgaaccgaaggggaccacggtacccatacagacaacaggaccctaacagtggacgcgtagacgcagacgtagacatcgagacgacgaccggtcctaatttacttacgtggtacgacggtaaggtacgttacggtttaccggtggtccgtttcggtttaccgttttacggg

SEQ ID NO: 349037 - DNA, 660 bp, Homo sapiens
  misc_feature: GZ8MTXP02F09KT.45.37.D04.1.454.CMB.2.raw
  modified_base (243)..(243): a, c, t, g, unknown or other
  misc_feature (243)..(243): n is a, c, g, or t
  modified_base (365)..(365): a, c, t, g, unknown or other
  misc_feature (365)..(365): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactgtacctggaggatcctcttcttggtggcagcagccacaagagcccactcccaggtgcagctggcgcagtctggggctgaggtgaggagccgtgggctcagtgaggtctctgcagcttngctacaccttcaccggcgactatctccacgtgggtgcgacgacggccccctggaccgaagggtcttggagtggagtgggatggactaccgaaacccctaacagtggtacggacaacaaactntacgacaaacgagtaacgtttcgaggggcgacggggtaccacccgagtacggaacccgaacggggacctaacccggttaccgaacgttaccgaacggaccaaaccgaacggtacccttaacgagttacgggagaccgttagacgacgtaacgaacgtcggaactacgtacgtacggaacccgaccgaccgggtacctaacgtttttaacgttaacgttcggttacggtaaccggtaaggtacgtttaccgggtttaaccggggtcggtttccggtttcgggttttttaacccggg

SEQ ID NO: 349038 - DNA, 501 bp, Homo sapiens
  misc_feature: GZ8MTXP02IDJ8Z.45.37.D04.1.454.CMB.2.raw
  modified_base (314)..(314): a, c, t, g, unknown or other
  misc_feature (314)..(314): n is a, c, g, or t
  modified_base (386)..(386): a, c, t, g, unknown or other
  misc_feature (386)..(386): n is a, c, g, or t
  modified_base (424)..(424): a, c, t, g, unknown or other
  misc_feature (424)..(424): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccggtctccagactcccctggctgtgtctctgggcgagagggccaccatcaactgcaagtccagccagagtgttttagacagctccaacaataagaactacttagcttggtaccagcagaaaccaggtcagcctcctaagctgctcatttacngggcatcgtacccggatccggggtcctgaccgattcagtgcagcgggtctgggacagatttcactctacaantcagcagcctgcaggctagaagatgtgctagtttatgntgtcatcaattattattatacttcctcgtactttcgcctaggaccaaagtgataatacaaacgactgacgctacgac

SEQ ID NO: 349039 - DNA, 518 bp, Homo sapiens
  misc_feature: GZ8MTXP02GUZRU.45.37.D04.1.454.CMB.2.raw
  modified_base (358)..(358): a, c, t, g, unknown or other
  misc_feature (358)..(358): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacacggccccctggacaagggcttgagtggatgggatggatcaaccccctaacaatggtgcacaaactntgcacagaagtttcagggcagggtcaccatgacagggacacgtcagtcagcacagcctacagtggagctgagcagactgactatcgtacgaccgacaccggcctaattttactactgtgcgaggtacgttcggtttaccggtggtcctttggttttcccg

SEQ ID NO: 349040 - DNA, 570 bp, Homo sapiens
  misc_feature: GZ8MTXP02HPQ79.45.37.D04.1.454.CMB.2.raw
  modified_base (223)..(223): a, c, t, g, unknown or other
  misc_feature (223)..(223): n is a, c, g, or t
  modified_base (306)..(306): a, c, t, g, unknown or other
  misc_feature (306)..(306): n is a, c, g, or t
  modified_base (349)..(349): a, c, t, g, unknown or other
  misc_feature (349)..(349): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagctggggctnagtgagtctcctgcagctctggctacaccttcaccgcgactatctccactgggtgcgacacggccccctggacaagggcttgngtggatgggatggatcaacccctacaagtggtgcaacaaactntgacacagtaaagtttcgagggtcaggggtcaccgagtacgaccgagggacacgtacagtcagacacacgcctacgagtggagctagacgcaaggacctaggaactattcgtacgacggtaccgaacggtcccttaaattttacttaaccgtggttcggaacggtagggtacgtttacgggtttacccgggtagggtttcccgtttggtttttaccccggg

SEQ ID NO: 349041 - DNA, 644 bp, Homo sapiens
  misc_feature: GZ8MTXP02IJN7T.45.37.D04.1.454.CMB.2.raw
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctgggctgaggtgaggagccgtgggcctnagtgaagtcnctgcaggctngctacnctcacgcactatctccacgtggtcgacgacacggtccccgtggaacgaagggtcttggacggtggagtgggataggactaaccgaaccctaacgaagtcggtaggacaaacgtaaacttagtcgacaaacgaaggtaaacgtttccgaggggactacggggtaccaacgaagtcgaaccgacgggaactaccggtaccaacgtacaacgaccaaccgaacgtacccctaagacgtaggacgtacgtacgacgacaaggactacgactacgtacgtacgaaaccgacgtaaaccggtacttaaacgtttaacttaccgtaggtacgtacggtaaacggtacgtttaccgggtttaaccggttggtaccgttttacgggttttaccgttttaacgggg

SEQ ID NO: 349042 - DNA, 566 bp, Homo sapiens
  misc_feature: GZ8MTXP02I7334.45.37.D04.1.454.CMB.2.raw
  modified_base (368)..(368): a, c, t, g, unknown or other
  misc_feature (368)..(368): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctggggcctcagtgaaggtctcctgcaaggcttctggctacaccttcaccggcgactatcctccactgggtgcgacacggcccctggacaagggcttggagtggagtgggatggataccaaccccctaacaagtggtacggacaacaaactntgacacgagtaagtttcgaggggcaacggggtcaaccgatcggaaccgagggtaccacgtaccatcagacacacgacctacagtcggagactagacggacacggactgaactagccgtagaccgacgacggacctaattttactacgtgtacggaacgtaggtattcggtttaccggtggtcgtttacggtttttccg

SEQ ID NO: 349043 - DNA, 602 bp, Homo sapiens
  misc_feature: GZ8MTXP02JL1LA.45.37.D04.1.454.CMB.2.raw
  modified_base (258)..(258): a, c, t, g, unknown or other
  misc_feature (258)..(258): n is a, c, g, or t
  modified_base (296)..(296): a, c, t, g, unknown or other
  misc_feature (296)..(296): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctcgagtgaaggtctccgtgcaaggcttcgnggctacaccttcaccggcgactatcctccacgtgggtncgacacggcccctggacgaagggtcttggaggtggagtgggatggactaccccaaacccttaacgaagttgggtacggaccaacaactagtagaccaaacgaggttaaacgtttcgaaggggtcagggtaccaaccgagtacgaaccgaggaccacgtccagtcacgcacacgacctacgagtgggacgcgtacggaggaccaaggaccgtagaactacgtaccgtaggaccggaccaccggtacctaacgtttactaacgtggtaacgcgtaggtacgttcggtttaccggtggtccgttttcgg

SEQ ID NO: 349044 - DNA, 506 bp, Homo sapiens
  misc_feature: GZ8MTXP02F92EN.45.37.D04.1.454.CMB.2.raw
  modified_base (358)..(358): a, c, t, g, unknown or other
  misc_feature (358)..(358): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctgaggtgaggaagcctgggggcctcagtgaaggtctcctgcaaggcttctggctacaccttcaccgggcgactatctccactgggtgcgacacggcccctggacaagggcttgagtggatgggatggatcaacccctaacatggtggcacaactntgcacagaagtttcagggcagggtcacatgacagggacacgtccatcagcacagcctacatggacgctagagcagactgacatctagacgacacggcctatttactactgtgcgaggtacttcggttaccggtggtcttggttttccg

SEQ ID NO: 349045 - DNA, 526 bp, Homo sapiens
  misc_feature: GZ8MTXP02ISD7T.45.37.D04.1.454.CMB.2.raw
  modified_base (432)..(432): a, c, t, g, unknown or other
  misc_feature (432)..(432): n is a, c, g, or t
  modified_base (504)..(504): a, c, t, g, unknown or other
  misc_feature (504)..(504): n is a, c, g, or t
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagccccactccccaggtgcagctggtgcagtctgggggctgaggtgaggaagcctgggggcctcagtgaaggtctcctgcaaggcttctggctacaccttcaccggcgactatctccactggggtgcgacaggccccctggacaagggcttgagtgggatggggatgggatcaaccctaacaatggtggacacaaaactatgcacagaagtttcagggcagggtcaccatgaccagggacacgtccatcagcacagcctacatgganctgagcagactagacatctagacgacacggcctaagtttactacgtgtgacgaaggtattcggtttaccggngtcgttaggtttccttttacgg

SEQ ID NO: 349046 - DNA, 522 bp, Homo sapiens
  misc_feature: GZ8MTXP02GY2T8.45.37.D04.1.454.CMB.2.raw
  modified_base (364)..(364): a, c, t, g, unknown or other
  misc_feature (364)..(364): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttctggctacaccttcaccggcgactatctccactgggtgcgacacggcccctggacaagggcttgagtggatggggatggatcgaaccccctaacaatgggtaggcacaaactntgacacagaagtttcgagggcagggtcaccatcgacaggggacacgtcagtcagcactcgacctacatggagccagagcaagactgacatcagacgacacggcctagttactactgtgaaggagtagtacggtttacggtcgtcgttggtttttaccg

SEQ ID NO: 349047 - DNA, 559 bp, Homo sapiens
  misc_feature: GZ8MTXP02F7LPX.45.37.D04.1.454.CMB.2.raw
  modified_base (444)..(444): a, c, t, g, unknown or other
  misc_feature (444)..(444): n is a, c, g, or t
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagcccactccccaggtgcagctggtgcagtctgggggctgaggtgaggaagcctgggggcctcagtgaaggtctcctgcaaggcttctggctacaccttcaccggcgactatctccacgtggggtgccgacacgggccccctggacaagggcttgagtggatggggatggatcaaccctaacagtggtagacacaaactatgacaacagtaagttcgagggtcagggtcacagtagaccgagggacacgtccatcagcactacgacctacgatggacnctaggacgacgagactaggaaccagtcctaggaaccgacgaacggccttaaatttactacgtagtgacggaaggtattcgggtttacggtggtacgtttcggtttccgttttagg

SEQ ID NO: 349048 - DNA, 503 bp, Homo sapiens
  misc_feature: GZ8MTXP02I2NLD.45.37.D04.1.454.CMB.2.raw
  modified_base (356)..(356): a, c, t, g, unknown or other
  misc_feature (356)..(356): n is a, c, g, or t
  modified_base (488)..(488): a, c, t, g, unknown or other
  misc_feature (488)..(488): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtctgggggctgaggtgaggaagcctggggcctcagtgaaggtctcctgcaaggcttctggctacaccttcaccggcgactatctccactgggtgcgacaggcccctggacaagggcttgagtggatgggatggatcaaccccctacaatggtgcacaaactntgcacagaagtttcaggggcaagggtcaccatgaccagggacacgtcatcagcacagcctacagtggagctgagcagactgacatctacgacgacacggcctatttactactgtgcgagattcggttacggnggtcttggttttccg

SEQ ID NO: 349049 - DNA, 508 bp, Homo sapiens
  misc_feature: GZ8MTXP02JFW2C.45.37.D04.1.454.CMB.2.raw
  modified_base (358)..(358): a, c, t, g, unknown or other
  misc_feature (358)..(358): n is a, c, g, or t
  modified_base (434)..(434): a, c, t, g, unknown or other
  misc_feature (434)..(434): n is a, c, g, or t
  modified_base (445)..(445): a, c, t, g, unknown or other
  misc_feature (445)..(445): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacacggcccctggacaagggcttgagtggatgggatggatcaacccctacaagtggtggcaacaaactntgcacagtaagtttcgagggcagggtcaccagtcgacaggggacacgtcatcagcacacgcctacatggagctgancagactgacanctgacgacacggctaatttactactgtgcgtaggattcggttaccggtggtcgttggtttccg

SEQ ID NO: 349050 - DNA, 512 bp, Homo sapiens
  misc_feature: GZ8MTXP02GS2AT.45.37.D04.1.454.CMB.2.raw
  modified_base (225)..(225): a, c, t, g, unknown or other
  misc_feature (225)..(225): n is a, c, g, or t
  modified_base (360)..(360): a, c, t, g, unknown or other
  misc_feature (360)..(360): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctnagtgaggtctcctgcaaggcttctggctacaccttcaccggcgactatctccactgggtgcgacacggcccctggacaagggcttgagtggatgggatggatcaaccccctaacaagtggtaggacaacaaactntgacacagtaagtttcgagggcagggtcaccatcgaccgagggacacgtcatcagcacagcctacatggagctagagcagactgacatctagacgacacgcctatttactactgtgcgagtacgttcgttacggtcgtcgttcggttttccg

SEQ ID NO: 349051 - DNA, 515 bp, Homo sapiens
  misc_feature: GZ8MTXP02FMANR.45.37.D04.1.454.CMB.2.raw
  modified_base (358)..(358): a, c, t, g, unknown or other
  misc_feature (358)..(358): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctgggggcctcagtgaaggtctcctgcaaggcttctggctacaccttcaccggcgactatctccactgggtgcgacaggcccctggacaagggcttgagtggatgggatggatcaaccccctaacaatggtggcaacaaactntgcacgagaagtttcagggcaggggtcaccatgaccagggacacgtcatcagcacagcctacatggagctgagacagactgacatctagacgacgacggcctaatttacttactgtagcgaggtacttcggttaccggtggtcgttcggttttaccg

SEQ ID NO: 349052 - DNA, 565 bp, Homo sapiens
  misc_feature: GZ8MTXP02FWH3D.45.37.D04.1.454.CMB.2.raw
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (372)..(372): a, c, t, g, unknown or other
  misc_feature (372)..(372): n is a, c, g, or t
  modified_base (479)..(479): a, c, t, g, unknown or other
  misc_feature (479)..(479): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtgggcctnagtgaaggtctcctgcaggcttcnggctacaccttcaccggcgacctatcctccacgtgggtcgcgacgacggcccctggacaagggtcttggagtggagtgggatggataccaaaccccctaacaagtgggtacgcaaacaaactntgacaacagtaagtttcgaggggctaggggtccaacgatacgacccgagggaccacggtccatcgacgcaacgacgacctaacagtaggagctagagcagactgacngtacagacgaacacggtacctaattttacacgttgtagaacggtaggtacgttcgggtttaccggtcggtcgtttcggttttaccg

SEQ ID NO: 349053 - DNA, 574 bp, Homo sapiens
  misc_feature: GZ8MTXP02HIJAO.45.37.D04.1.454.CMB.2.raw
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaggtctcctgcaaggcttctggctacaccttcaccggcgactatcctccactgggtgcgacacggcccctggacaagggcttgagtggagtggggatggatacccaaaccctaacaaacgtgggttaggacaacgaactagtagaccacagtaagtttcgaggggtcgaggggttcaccgagtcgaccgagggacacgtcagtacacgacacagcctacacgtaggacgcgtgacgcaacgacctaggacataccgtaggaccgacgacggacctactttacgttacctaggttaagcgtagggtaacttggtttacccgggtgttacggtttttccggg

SEQ ID NO: 349054 - DNA, 615 bp, Homo sapiens
  misc_feature: GZ8MTXP02IAI6H.45.37.D04.1.454.CMB.2.raw
  modified_base (184)..(184): a, c, t, g, unknown or other
  misc_feature (184)..(184): n is a, c, g, or t
  modified_base (193)..(193): a, c, t, g, unknown or other
  misc_feature (193)..(193): n is a, c, g, or t
  modified_base (200)..(200): a, c, t, g, unknown or other
  misc_feature (200)..(200): n is a, c, g, or t
  modified_base (256)..(256): a, c, t, g, unknown or other
  misc_feature (256)..(256): n is a, c, g, or t
  modified_base (296)..(296): a, c, t, g, unknown or other
  misc_feature (296)..(296): n is a, c, g, or t
  modified_base (476)..(476): a, c, t, g, unknown or other
  misc_feature (476)..(476): n is a, c, g, or t
  modified_base (532)..(532): a, c, t, g, unknown or other
  misc_feature (532)..(532): n is a, c, g, or t
  modified_base (579)..(579): a, c, t, g, unknown or other
  misc_feature (579)..(579): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtncagctggtncagtcgnggggctggaggtgaggaagccgtggggcctgagtgaaggtctcctgcaggcttcgnggctactaccttcgaccggcactatcctccacgtgggtcncgacgacggcccctaggacgaagggtcttggaggttggagtggggaatggactacccgaaaccctaagagtgggtagacgaactaactgtacgacctaacgtaagtaacggtttacgacgggtaccgacggggtaccacgtacgtacggaacccggtaaggggaacctaccgtaccgaanccgaacgaccaacgacgtaccgttaacgaagtgggactcgagaacgtcgaggtacngacactcgacgacgaccgtacgtacttagtttacgtacgtgtaacgngtacggttcgtacggtttcggtcgtttcgtttcggg

SEQ ID NO: 349055 - DNA, 540 bp, Homo sapiens
  misc_feature: GZ8MTXP02H3GL4.45.37.D04.1.454.CMB.2.raw
  modified_base (370)..(370): a, c, t, g, unknown or other
  misc_feature (370)..(370): n is a, c, g, or t
  modified_base (460)..(460): a, c, t, g, unknown or other
  misc_feature (460)..(460): n is a, c, g, or t
  modified_base (518)..(518): a, c, t, g, unknown or other
  misc_feature (518)..(518): n is a, c, g, or t
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagcccactccccaggtgcagctggtgcagtctgggggctgaggtgaggaagccgtggggcctcagtgaaggtctcctgcaaggcttctggctacaccttcaccggcgactatctccactggggtgcgacacggcccctggacaaggggcttggagtggagtgggatggactcaaaccctaacaatgggtagacacgaaaacctntgacaacagtaagtttcgagggcagggtcaccgatcgacgagggacacgtcatcagcacagcctacagtggacgcagagcgagactgacntctgacgacgacggcctagtttacttacgtgtcgcgaaggtcgttacggtttaccggngtcgttcggtttaccgtttagg

SEQ ID NO: 349056 - DNA, 623 bp, Homo sapiens
  misc_feature: GZ8MTXP02HSTQG.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcgaccggcgactactcctccacgtgggtcgcgacgacggccccgtaggaaccgaagggtcttaggaggttggagtggggatggaataccaaaccccctaaacgaagtggtacggacaaacaaactagtgacaacgaagtaagtttacgaggggtcgaggggtacaacccgtagacggaaccgaacggggacctaaccggttaccaactcgaacgaccaaccgacgtaccctaacgtaagtgggaacgccgtaggacgacgaaggactagacactacgacggaacgaccgaccggtacttaagtttactacgtgtagaacgtaggtagtttcggttacggttcggtcgtttcgttttccgg

SEQ ID NO: 349057 - DNA, 544 bp, Homo sapiens
  misc_feature: GZ8MTXP02G59S6.45.37.D04.1.454.CMB.2.raw
  modified_base (359)..(359): a, c, t, g, unknown or other
  misc_feature (359)..(359): n is a, c, g, or t
  modified_base (444)..(444): a, c, t, g, unknown or other
  misc_feature (444)..(444): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaggtctctgcaggcttctggctacaccttcaccggcgactatctccacgtgggtgcgacacggccccgtggacaagggcttggagtggatgggatggatcgaaccccctaacagtggtgacacgaaactntgacacgagtaagtttcgagggcgagggtcaccagtcgaccgagggtacacgtaccagtcacgcacacgcctacgagtggagcgngagacgagactagaccatcgtacgacgacgaccggactactttacgttacgtgtagcggtaggtattacggtttaccggtggttcgtttcggttttccgg

SEQ ID NO: 349058 - DNA, 602 bp, Homo sapiens
  misc_feature: GZ8MTXP02F4TE2.45.37.D04.1.454.CMB.2.raw
  modified_base (370)..(370): a, c, t, g, unknown or other
  misc_feature (370)..(370): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttctggctacaccttcaccggcgactatcctccacgtgggtgcgacacggcccctggacgaagggcttgagtggagtgggatggactcaaccccctaacaagtggtaggacaacgaaactntcgacaacgagtaagtttcgaagggcaggggtaccaccgagtacgaccgagggacaccgtaccatcaagcaacacgacctaacgagtagggacgcgtagacgacacggactggaacctaatcgtaacggaccgaaaccgaccggtacctaagttttaacttaaccgtggttacggaaccggtaagggtagtttacgggtttaacccggtggtcgttttaccggtttttaccg

SEQ ID NO: 349059 - DNA, 525 bp, Homo sapiens
  misc_feature: GZ8MTXP02I6EFA.45.37.D04.1.454.CMB.2.raw
  modified_base (314)..(314): a, c, t, g, unknown or other
  misc_feature (314)..(314): n is a, c, g, or t
  modified_base (364)..(364): a, c, t, g, unknown or other
  misc_feature (364)..(364): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctcaacaataagaactacttagcttaggtaccagacaagaaaccaggtcagcctactaagctgctcatttacnggcatccgtacccgggaatccggggtccccctgaccgtattcgagtggcnggcgggtctgggacagtatttcactctcaccatcagcagcctgcagctagaagntgngntagttatgctgcagtntaatnttatatacttcctaccgtacgtttcgaccgtacggaacctaaggtcgtaacgtactacgaaaacgtagtcgtcggtactcg

SEQ ID NO: 349060 - DNA, 531 bp, Homo sapiens
  misc_feature: GZ8MTXP02HQAQR.45.37.D04.1.454.CMB.2.raw
  modified_base (362)..(362): a, c, t, g, unknown or other
  misc_feature (362)..(362): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctcaacaataagaactacttagctggtaccagcagaaacaggtcagcctctaagctgctcatttctgggcatccgtacccgggaatcccggggtcccccctgaccgtattccgagtcggcnggtcgggtctgggaccagtactttcactctcaccatcagcagcctgcaggctagaagtagtgtaggctagtttatgtctgtcagctaaattattattatcttcctcgtactttcggaccctaggaccctaaaaggtgaacttacaacgtaaacacgtcgtacggtctcg

SEQ ID NO: 349061 - DNA, 527 bp, Homo sapiens
  misc_feature: GZ8MTXP02IZ0XC.45.37.D04.1.454.CMB.2.raw
tcagacgcgatcgacacgaccggtgctcgatttagtagcatactgttggggtttgggggcatcaccccagcaaccacatctgtcctctagagaatccccctgagagctccgttcctcaccatggactggacctggaggatcctcttcttggtggcagcagccacaagagcccactcccaggtgcagctggtgcagtctgggggctgaggtgaggaagcctgggggcctcagtgaaggtctcctgcaaggcttctggctacaccttcaccggcgactatctccactggggtgcgacagggccccctggacaaggggcttgagtggatggggatgggatcaaccctaacaatggtggcacaaaactatgcacagaagtttcagggcagggtcaccatgacaggacacgtccatcagcacagcctacatggagctgagcaggactgacaatctagacggacacgggaccatttaactactagttgacgaaggaatcggtttaccggtggtccttcggtttcctttttagg

SEQ ID NO: 349062 - DNA, 623 bp, Homo sapiens
  misc_feature: GZ8MTXP02IXC40.45.37.D04.1.454.CMB.2.raw
  modified_base (362)..(362): a, c, t, g, unknown or other
  misc_feature (362)..(362): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatcctccactgggtgcgacaggccccctggaccaagggcttgagtggatgggatggatcaaccccctaacaatggtggacaacaaactntgcaacagtaagtttcaggggcaggggtcaccatgaccaggggacacgtcagtcagcaacacgaccctacaagtcgggagaccgtaggacgacgaacggaaccttaggaaccacgttaccgtaacggaacccggaaaccacccggggtacccttaaatttttaaccgttaaccgttgggttacggaaccggtaacggggttaaagtttcggggttttaaccccggggtttgggtaccgttttacggggtttttttacccgg

SEQ ID NO: 349063 - DNA, 530 bp, Homo sapiens
  misc_feature: GZ8MTXP02G0QNP.45.37.D04.1.454.CMB.2.raw
  modified_base (314)..(314): a, c, t, g, unknown or other
  misc_feature (314)..(314): n is a, c, g, or t
  modified_base (407)..(407): a, c, t, g, unknown or other
  misc_feature (407)..(407): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctaccaaacaataagaactacttagcttggtaccagcaagaaaccaggtcagcctctaagctgctcatttacngggcatccgtacccgggaactccggggtccccctgaccgtattcaggtggcagggtcgggtctggggaccagtactttcactctcaccatcancagcctgcagctagaagatgtggactagtttatgactgtacagactaattattattatacttacctctacgtttcggaccgtggaacctaagtcgaatactacaaacgtactgtacggctacg

SEQ ID NO: 349064 - DNA, 510 bp, Homo sapiens
  misc_feature: GZ8MTXP02HIXCQ.45.37.D04.1.454.CMB.2.raw
  modified_base (357)..(357): a, c, t, g, unknown or other
  misc_feature (357)..(357): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctgggggcctcagtgaaggtctcctgcaaggcttctggctacaccttcaccggcgactatctccactgggtgcgacaggcccctggacagggcttgagtggatgggatggatcaaccccctaacaatggtggcacaaactntgacacagaagttcagggcagggtcaccatgacagggacacgtcatcagcacacgcctacagtggacgctgagcagactgactatctagacgacgaccggcctaatttactactgtgcgaggtactggtttaccggtggtcttcggttttccg

SEQ ID NO: 349065 - DNA, 580 bp, Homo sapiens
  misc_feature: GZ8MTXP02JSXSJ.45.37.D04.1.454.CMB.2.raw
  modified_base (256)..(256): a, c, t, g, unknown or other
  misc_feature (256)..(256): n is a, c, g, or t
  modified_base (353)..(353): a, c, t, g, unknown or other
  misc_feature (353)..(353): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaagtctctgcagcttctggctacncctcaccggcactatctccacgtgggtcgcgacgacggcccctggaacgaagggtcttaggaggtggagtggggatggactaccaaacccccgtaanagtgggtacggacaaacaaactgcgacaacgagtaagtttacgaggggcgagggtacaaccgagtacgaccgagggacaccgtaccatcgacgcacgacgacctacgagtaggagctaggacgacgagactagaacagtcgtacggaccgaacgaccggaccttagtttactacgtgtcgaacggtaggtacgtttacggttacggtcggtcgtttcggttttaccg

SEQ ID NO: 349066 - DNA, 545 bp, Homo sapiens
  misc_feature: GZ8MTXP02HM7A6.45.37.D04.1.454.CMB.2.raw
  modified_base (359)..(359): a, c, t, g, unknown or other
  misc_feature (359)..(359): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgtttagacagctcaacaataagaactactagcttggtaccagcagaaaccaggtcagcctcctaagctgctcatttactggcatccgtacccgggatcccggggtccccctgaccgattcagtggcnggtcgggtctggggacagtatttcactctcaccatcagcacgcctagccgaggctagaaagagtggtggtctagtttatgctgtcagactaattattattattacttcctaccgttacgttccggtcccgtagggtaaccctaaaggtcggaataacgtaaccaaaacgtaactggtacggctacg

SEQ ID NO: 349067 - DNA, 602 bp, Homo sapiens
  misc_feature: GZ8MTXP02HB4IC.45.37.D04.1.454.CMB.2.raw
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (362)..(362): a, c, t, g, unknown or other
  misc_feature (362)..(362): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaggtctcctgcaggcttcnggctacnccttcaccggcgactatcctccacgtgggtgcgacacggcccctggacaggctgagtggatgggatggataccaaccccctaacaagtggtacggacaacgaaactntgacacgagtaagtttcgaggggcaggggtcaaccgagtacgaccgaaggggacaccggtaccagtccgagaccacgacgaccctacagtaggagcctggacgacgaagacctaggacctagtacgtacgaaccgaccgaccggtaccttaaacgttttacgttaaccgttggtcgtaaccggtaaggtaacggtttcgggtttaaccgggtcgggttacgtttcggggtttttacccgg

SEQ ID NO: 349068 - DNA, 524 bp, Homo sapiens
  misc_feature: GZ8MTXP02IVG92.45.37.D04.1.454.CMB.2.raw
  modified_base (443)..(443): a, c, t, g, unknown or other
  misc_feature (443)..(443): n is a, c, g, or t
  modified_base (456)..(456): a, c, t, g, unknown or other
  misc_feature (456)..(456): n is a, c, g, or t
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagcccactccccaggtgcagctggtgcagtctgggggctgaggtgaggaagcctgggggcctcagtgaaggtctcctgcaaggcttctggctacaccttcaccggcgactatctccactggggtgcgacagggccccctggacaaggggcttgagtggatggggatgggatcaaccctaaccaatggtggacacaaaactatgcacagagtttcagggcaggggtcaccatcgacgagggacacgtccagtcagacacagacctacatggagctgancagactgacatcngacgacgacggcctattacttactgtgcgaagacttcggttaccggtggtcttcggtttcttttacgg

SEQ ID NO: 349069 - DNA, 599 bp, Homo sapiens
  misc_feature: GZ8MTXP02JFDMS.45.37.D04.1.454.CMB.2.raw
  modified_base (371)..(371): a, c, t, g, unknown or other
  misc_feature (371)..(371): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctcctgcaaggcttctggctacaccttcaccggcgactatctccacgtgggtgcgacacggcccctggacgaagggcttggaggtggagtgggatggatccaaaccccctaacgagtggtggacaacgaaactntgacacgagtaagtttcgagggcagggtcacgatcgacgagggacacgtccatcacgcaacgacgacctacgagtgggaacgtccgtaggacggacgaacgacgtacggaactaatccgtacggaaccggaccgtaacccgggtaccttaaagttttacttaaccgtggttacgaacggtaggtagtttacgggtttacccgggtggttccgtttcgggtttttcccg

SEQ ID NO: 349070 - DNA, 622 bp, Homo sapiens
  misc_feature: GZ8MTXP02HH67A.45.37.D04.1.454.CMB.2.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctgaggtgaggagccgtgggcctnagtgaggtctctgcaggcttnggctacaccttcaccggcgactactcctccacgtgggtcgcgacgacggccccctagggaccaaggggtcttaggaggtggagtgggatggactaccaaaccccctaanagtggtacggacaacaaactntcgacaacgagtaacgttcgaggggcgtacgggtacaaccgagtacggacgagggaccacgtacagtcagacaacgacgacctacgagtacgggactacgtaggacgaccgaagacgtacggaacctaacgtccgtaacggaccgaccgtaaccgggtacttaaacttttacgttaccgtaggttacggaacggtagggtaacgtttcgggtttaaccggtcggtttcggtttcggtttttacccgg

SEQ ID NO: 349071 - DNA, 585 bp, Homo sapiens
  misc_feature: GZ8MTXP02GVAUK.45.37.D04.1.454.CMB.2.raw
  modified_base (258)..(258): a, c, t, g, unknown or other
  misc_feature (258)..(258): n is a, c, g, or t
  modified_base (358)..(358): a, c, t, g, unknown or other
  misc_feature (358)..(358): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacnccttcaccggcgactatcctccactgggtgcgacacggccccgtggacaagggcttgagtggatgggatggatcaacccctacatggtggacacaaactntgacacgagtagtttcgaggggcgacggggtcaccgagtacggacccgaaggggaacaccggtccaacgtcacgacaacgacggaccttacgagtgggacgcgtacgagcgaagactaggacatacgtacggacgaccgaccggtactaacgttttacgtaccgttagtcggaacggtaggtacgtttacgggttaaccggttcggtcggtttcggtttttacccgg

SEQ ID NO: 349072 - DNA, 511 bp, Homo sapiens
  misc_feature: GZ8MTXP02FUYOV.45.37.D04.1.454.CMB.2.raw
  modified_base (358)..(358): a, c, t, g, unknown or other
  misc_feature (358)..(358): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctgaggtgaggaagcctgggggcctcagtgaaggtctcctgcaaggcttctggctacaccttcaccggcgactatctccactgggtgcgacaggcccctggacaaggggcttgagtggatgggatggatcaacccctaacatggtggcacaaactntgcacagaagtttcaggggtcaggggtcacccgatgacccgagggacacgtaccatcagcacagcctacatggagctgagcagactgacatctgacgacacggccatttacttactgtagcgaggattcggttaccggtggcttggttttccg

SEQ ID NO: 349073 - DNA, 616 bp, Homo sapiens
  misc_feature: GZ8MTXP02HC9VL.45.37.D04.1.454.CMB.2.raw
  modified_base (370)..(370): a, c, t, g, unknown or other
  misc_feature (370)..(370): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatcctccacgtggtgcgacgacggcccctggacgaagggcttggagtggagtgggatggactacaaaccccctaacaagtggtggacaacgaaactntagacaacgtagtaagttcgacgggacgacgggtcaccagtacgaaccgaggggacaccggtcacgtacgacgacacacgacctaactagtagggagccaggacgacgtaacgtacgtacgaactacgtaccgtacggaccgaccgtaacccggtaccttaaacgttttacgttaaccgttcggttaggccggtaaggtagtttacgggtttaaccggtcggttacggtttcggttttttacccgg

SEQ ID NO: 349074 - DNA, 547 bp, Homo sapiens
  misc_feature: GZ8MTXP02IIB7L.45.37.D04.1.454.CMB.2.raw
  modified_base (241)..(241): a, c, t, g, unknown or other
  misc_feature (241)..(241): n is a, c, g, or t
  modified_base (318)..(318): a, c, t, g, unknown or other
  misc_feature (318)..(318): n is a, c, g, or t
  modified_base (341)..(341): a, c, t, g, unknown or other
  misc_feature (341)..(341): n is a, c, g, or t
  modified_base (453)..(453): a, c, t, g, unknown or other
  misc_feature (453)..(453): n is a, c, g, or t
tcagacgcgatcgacacgaccggtgctcgatttagtagcatactgttgggtttgggggagagcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggaagctggggctcagtgaaggtctccngcaaggctctggctacaccttcaccggcgactatctccactggtgcgacacgcccctggacaagggcttgagtggangggatggactccaaacccctaanaagtggtaggacaacaactatagacaacaagtaagtttcgaagggcagggtcacatagacgagggacacgtcatcagcacacgctaacagtggacgctagagacgacgtacngaacaacttcgagaccgaacaaccggaccttaatttacgtacgtgtaaccggacgtaacggtagttacggtttaccggtggttcgttttccggg

SEQ ID NO: 349075 - DNA, 575 bp, Homo sapiens
  misc_feature: GZ8MTXP02FV0KM.45.37.D04.1.454.CMB.2.raw
  modified_base (317)..(317): a, c, t, g, unknown or other
  misc_feature (317)..(317): n is a, c, g, or t
  modified_base (360)..(360): a, c, t, g, unknown or other
  misc_feature (360)..(360): n is a, c, g, or t
  modified_base (414)..(414): a, c, t, g, unknown or other
  misc_feature (414)..(414): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttagacagctaccaaacaataaagaactacttagcttggtaccagcagaaaccaggtcagcctacctaagctgctcatttacnggcatccgaccggaatccggggtcccctgaccattcagtggcnggcgggtctgggacagtatttcactctcaccatcagcagcctgcagctgaaagntgtggactagtttagtgctgtcagtactaaattatttattacttactttcccgtacccgttaacttttcccgggacccgttacggggaaaccctaaaagggttggtaaacgtttaactaaaccgaaaaaccggtacttaagggttacgggccctttaacgg

SEQ ID NO: 349076 - DNA, 575 bp, Homo sapiens
  misc_feature: GZ8MTXP02GGALS.45.37.D04.1.454.CMB.2.raw
  modified_base (326)..(326): a, c, t, g, unknown or other
  misc_feature (326)..(326): n is a, c, g, or t
  modified_base (423)..(423): a, c, t, g, unknown or other
  misc_feature (423)..(423): n is a, c, g, or t
  modified_base (458)..(458): a, c, t, g, unknown or other
  misc_feature (458)..(458): n is a, c, g, or t
  modified_base (468)..(468): a, c, t, g, unknown or other
  misc_feature (468)..(468): n is a, c, g, or t
tcagacgcgatcgacacgaccggtgctcgatttagtagcatactgttgggtttgggggagctacaacaggcaggcaggggcagcaagatggtgatgcagacccaggtcttcatttctctgttgctctggatctctggtgccgtacggggacatcgtgatgacccagtctccagactccctggctgtgtctcgtgggcgagagggccaccatcaactgacaagtccagccagtagttgtttagacagctaccaaacaataagaactacttagcttggtaccagcaacgaaaccaggtacacgcctacctaagctgctctatttacgnggcagtccgtaaccgggagtcccccggggtcctgaccgtattcgaggtggcgaggcgggtgtgggacagtactttcactctacacatcagcacgccngccaggctaggagtatggtgacttaggtttatcgnttagcgaatntaaatttattatttacttacttcccgtacgttaccgtttaccggcccgttaagggtaaccctaaaaggtggtaactaacgtaacgtaaaaccgtagtcggtcggtac

SEQ ID NO: 349077 - DNA, 505 bp, Homo sapiens
  misc_feature: GZ8MTXP02FMYFG.45.37.D04.1.454.CMB.2.raw
  modified_base (362)..(362): a, c, t, g, unknown or other
  misc_feature (362)..(362): n is a, c, g, or t
  modified_base (418)..(418): a, c, t, g, unknown or other
  misc_feature (418)..(418): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctaccaacaataagaactacttaagcttggtaccagcaagaaaccaggtcagcctcctaaagctgctcatttactggcatcgtacccggaatccggggtcccctgaccgattcagtggcnggcgggtctggggacagtatttcactctcaccatcagcagcctgcaggctgaaagntggtgctagtttatgctgtcagcaattattattatactcctcgtacttcgcctaggacaagtgaatactacaaacgactgtgctacg

SEQ ID NO: 349078 - DNA, 519 bp, Homo sapiens
  misc_feature: GZ8MTXP02JXFQ3.45.37.D04.1.454.CMB.2.raw
  modified_base (253)..(253): a, c, t, g, unknown or other
  misc_feature (253)..(253): n is a, c, g, or t
  modified_base (426)..(426): a, c, t, g, unknown or other
  misc_feature (426)..(426): n is a, c, g, or t
  modified_base (479)..(479): a, c, t, g, unknown or other
  misc_feature (479)..(479): n is a, c, g, or t
  modified_base (486)..(486): a, c, t, g, unknown or other
  misc_feature (486)..(486): n is a, c, g, or t
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagcccactcccaggtgcagctggtgcagtctgggggctgaggtgaggaagcctgggggcctcagtgaaggtctcctgcaaggcttcnggctacaccttcaccggcgactatctccactgggtgcgacacggccccctggacgaagggcttggagtggatggggatggatcaacctaaccagtggtggacacaaactatgacacagtagttcgagggcagggtcacagtcgacgaggacacgtccatcacgcacagcctanagtggagctagagcagactgacatctagacgacacgctattactcgtcgtcgngaaggtnttacggttacggtgtcgttcggtttctttacgg

SEQ ID NO: 349079 - DNA, 533 bp, Homo sapiens
  misc_feature: GZ8MTXP02GTAJ2.45.37.D04.1.454.CMB.2.raw
  modified_base (339)..(339): a, c, t, g, unknown or other
  misc_feature (339)..(339): n is a, c, g, or t
  modified_base (356)..(356): a, c, t, g, unknown or other
  misc_feature (356)..(356): n is a, c, g, or t
  modified_base (407)..(407): a, c, t, g, unknown or other
  misc_feature (407)..(407): n is a, c, g, or t
  modified_base (423)..(423): a, c, t, g, unknown or other
  misc_feature (423)..(423): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacaccttcaccggcgactatctccactgggtgcgacaggcccctggacaagggcttggagtggatgggatggatcaacccctaanaatggtagcacaaactngcacagaagttcagggcagggtcacatgacagggcaacgtcagcagcaacncgcctacagtggatcngagcagactgactatcgtagaccgacgacggtaccctaattttacttaacgtgttacgaacggtaggtaagttcgggtttaacccgggtggtccgtttacggtttttccg

SEQ ID NO: 349080 - DNA, 790 bp, Homo sapiens
  misc_feature: GZ8MTXP02HWG8F.45.37.D04.1.454.CMB.2.raw
  modified_base (255)..(255): a, c, t, g, unknown or other
  misc_feature (255)..(255): n is a, c, g, or t
  modified_base (352)..(352): a, c, t, g, unknown or other
  misc_feature (352)..(352): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagtagttagtttagacagcctaaccaanaaataacgaactacttagtcgttacggtaaccagacaaacgaaaccgtacggtacacgtaccctaccgtaacgcctgtacctacttaacgtttacgngggtacctacgttaccccggtaaaccccggggtaacggttccccggggtaccccctacggaacccgttataccggtaaggtcggacgtacgggggtccggggtacggtacgggaaccgtaaggttactttaccgtacccttacctacccaaacctacgtaccgacgcccgtaaccggtcccgtacggaacgtacgggtacgtaaggaaagtgttggggtacggtagttttaaggttttagtcgtccgttggaacctaaggtaactttaaaattttagtttaaactttaaacgtttccctttaaccccgtttcccggttaaacccgttttcccgggggaacccgtaaacgggggtaaaacccttaaagggtttcggtaaaacttacccgtaaaaccggtaaaaacggttaccggtttggtaccggtttacggtaacccg

SEQ ID NO: 349081 - DNA, 614 bp, Homo sapiens
  misc_feature: GZ8MTXP02IRWNU.45.37.D04.1.454.CMB.2.raw
  modified_base (371)..(371): a, c, t, g, unknown or other
  misc_feature (371)..(371): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttcgtggctaccaccttcaccggcgactatctccactgggtgcgacacggcccccgtggacgaagggcttggagtggagtgggatggataccaaacccctaacaagtggtacgacaacaaaatntgacaacgagtaagtttcgaaggggcaaggggtcaccgaagtcgaaccgaagggacaaccgtccaataccacgaccaacgagaccctaatagtagggacgcgtagaacgcaacgactgaacactacgacggaccgaaaccgaccgggtaccttaaattttacgtaccgttggttacgaaccggttaggtaaacgtttcggggtttaaccgggtcggttaccggttttcgggttttttacccgg

SEQ ID NO: 349082 - DNA, 679 bp, Homo sapiens
  misc_feature: GZ8MTXP02JH8HN.45.37.D04.1.454.CMB.2.raw
  modified_base (291)..(291): a, c, t, g, unknown or other
  misc_feature (291)..(291): n is a, c, g, or t
  modified_base (383)..(383): a, c, t, g, unknown or other
  misc_feature (383)..(383): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctgagtgaaggtctcctgcaaggctctggctacaccttcaccggcgactatcctccacgtgggtncgacgacggcccctggacgaagggcttgggagtggagtggggatggactaccccgaaacccgtaaacgaagtgggtacggaccaaacaactntagaccaacgaagtaaacgtttcgaggggacaggggtaccaaccgagtacgacccgagggaccacgtaccatcgaagcaacgacgcctaacgacgtaggacgtacgtaggaacgaccgaaggacccgttagggaacctaacgttccgtaaccgggaaaccggtaacccggaaaccggttaacccgtttaaaagtttttaaaccgtttacccgtttaacgggtaaggtacccgggtaaagggttaccggtttaccggggttttaacccgggttcggggttaccgtttttaccggggg

SEQ ID NO: 349083 - DNA, 527 bp, Homo sapiens
  misc_feature: GZ8MTXP02GC7AS.45.37.D04.1.454.CMB.2.raw
  modified_base (342)..(342): a, c, t, g, unknown or other
  misc_feature (342)..(342): n is a, c, g, or t
  modified_base (360)..(360): a, c, t, g, unknown or other
  misc_feature (360)..(360): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacaccttcaccggcgactatctccactgggtgcgacgaggtcccctggacaagggcttgagtggagtgggatggatcaaccccctaanaatggtggcaacaaactntgacacagaagtttcgagggcaggggtcaccgatacgaccaggggacacgtccatcagcacagcctacatggacgctagagcaaggactggaacatcacggacgacacggcctatttactactgttgaacgagtagttcggttaccggtggtcgttggttttacccg

SEQ ID NO: 349084 - DNA, 602 bp, Homo sapiens
  misc_feature: GZ8MTXP02I39QN.45.37.D04.1.454.CMB.2.raw
  modified_base (254)..(254): a, c, t, g, unknown or other
  misc_feature (254)..(254): n is a, c, g, or t
  modified_base (347)..(347): a, c, t, g, unknown or other
  misc_feature (347)..(347): n is a, c, g, or t
  modified_base (413)..(413): a, c, t, g, unknown or other
  misc_feature (413)..(413): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaaggtctcctgcaaggcttcnggctacaccttcgaccggcgactactctccactgggtgcgacacggcccctggacaagggcttggagtggagtgggatggatcaacccctaanaatggtaggacaacaaaactgtagacaacgaagtaagtttcgaggggacaggggtaccaaccgaanacggaacccgaacgggggaacctaccggtaccaagtaccgaaggaccaaacaaccggacctaaccagtacgggacgccgagagacaaggactagaaccatcgacgacgaccgacggacctaatttacttaactggagaacggtaaggtacgtttacggttaaccggtggtccgtttcggtttttcccgg

SEQ ID NO: 349085 - DNA, 554 bp, Homo sapiens
  misc_feature: GZ8MTXP02JHWPS.45.37.D04.1.454.CMB.2.raw
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacacggcccctggacaagggcttgagtggatggggatggatcaaccccctacaagtggnggcaacgaaactntgcacgagtaagtttcgaggggcagggtcaccgatcgacagggacacgtcatcagcacacgacctacagtaggacgctagagcgaaggactacggaacacgtcgtacgaaccgacgaccggacctaatttacgttacgtgttacgaacgtaaggtacgtttacggtttacggtcggtccgttgggtttttaccg

SEQ ID NO: 349086 - DNA, 538 bp, Homo sapiens
  misc_feature: GZ8MTXP02FWAN6.45.37.D04.1.454.CMB.2.raw
  modified_base (261)..(261): a, c, t, g, unknown or other
  misc_feature (261)..(261): n is a, c, g, or t
  modified_base (366)..(366): a, c, t, g, unknown or other
  misc_feature (366)..(366): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacnccttcaccggcgactatcctccacgtgggtgcgacacggcccctggacaagggcttgagtggatgggatggatcccaaaccctacgaatgggtggacaacaactntacgacaacagtaagtttcgagggcgagggtacacatcgaccgaggacacgtccatacagaccacacgaccctacagtaggagcgtagagaccgagactagacatcgtagacgaccgacggacctagtttactacgtgtgcgaaggtatcggtttaccggtggtctttcggg

SEQ ID NO: 349087 - DNA, 643 bp, Homo sapiens
  misc_feature: GZ8MTXP02F3R93.45.37.D04.1.454.CMB.2.raw
  modified_base (352)..(352): a, c, t, g, unknown or other
  misc_feature (352)..(352): n is a, c, g, or t
  modified_base (372)..(372): a, c, t, g, unknown or other
  misc_feature (372)..(372): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttctggctacaccttcaccggcgactatcctccacgtgggtgcgacgacggcccctaggacaagggcttggagtggagtgggatggactaccaaacccctaanagtggtggacaacaaaactntgacaacgaagtaacgtttacgaagggggcaaggggtaccaaccgagtacggaaccgaaggggaccaccgtaccatacgacgacaacgacgtacctaacgagtcgggaacgtcgtaggacgacgaacgggaacctaggaacctagttaccgtaggtacgtaccggaaccgtaacccgggtaccttaaatttttaacgttaccggttaggtaacggtacgtaagggttacgtttaccggggtttaaccgggttggttaccgtttttccgggg

SEQ ID NO: 349088 - DNA, 527 bp, Homo sapiens
  misc_feature: GZ8MTXP02IOKOY.45.37.D04.1.454.CMB.2.raw
  modified_base (320)..(320): a, c, t, g, unknown or other
  misc_feature (320)..(320): n is a, c, g, or t
  modified_base (366)..(366): a, c, t, g, unknown or other
  misc_feature (366)..(366): n is a, c, g, or t
  modified_base (421)..(421): a, c, t, g, unknown or other
  misc_feature (421)..(421): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
  modified_base (437)..(438): a, c, t, g, unknown or other
  misc_feature (437)..(438): n is a, c, g, or t
  modified_base (440)..(440): a, c, t, g, unknown or other
  misc_feature (440)..(440): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctaccaaacaaataagaactacttagcttcggtaaccagacaagaaaccaggtcagcctactaagctgctcatttacnggcatccgtaaccgggaactccggggtcccctcgaccatcagtgcnggcgggtctggcaagtcttacactctcaaccatcagcagcctgcaggctagagtntgngntagtttngntnnanataattattactattacttccgtcgttacgttccggaccgtacggaactaaggtgtaactaacgaactaaacgtagtcgtcgactcg

SEQ ID NO: 349089 - DNA, 509 bp, Homo sapiens
  misc_feature: GZ8MTXP02I0501.45.37.D04.1.454.CMB.2.raw
  modified_base (341)..(341): a, c, t, g, unknown or other
  misc_feature (341)..(341): n is a, c, g, or t
  modified_base (355)..(355): a, c, t, g, unknown or other
  misc_feature (355)..(355): n is a, c, g, or t
  modified_base (422)..(422): a, c, t, g, unknown or other
  misc_feature (422)..(422): n is a, c, g, or t
  modified_base (437)..(437): a, c, t, g, unknown or other
  misc_feature (437)..(437): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctgggggctgaggtgaggaagcctggggcctcagtgaggtctcctgcaaggcttctggctacaccttcaccggcgactatctccactgggtgcgacaggccccctggaccaagggcttgagtggatgggatggatcaacccctanatggtgcacaactntgcacagaagttcagggcagggtcaccatacgacagggacacgtcatcagcactagcctacatgganctgagcagactgacntctacgacgacacggacctatttactactgtacgcggagtacgttcggttaccgtggtcgttaggttttccg

SEQ ID NO: 349090 - DNA, 520 bp, Homo sapiens
  misc_feature: GZ8MTXP02H0JUF.45.37.D04.1.454.CMB.2.raw
  modified_base (357)..(357): a, c, t, g, unknown or other
  misc_feature (357)..(357): n is a, c, g, or t
  modified_base (481)..(481): a, c, t, g, unknown or other
  misc_feature (481)..(481): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacacggcccctggacaagggcttgagtggatgggatggatcaacccctaacaatggtggcacaaactntgcacagtaagtttcagggcagggtcacatgacagggacacgtcatcagcacagcctacagtggagctgagacagactgacatcgtcgacgacaccggtactaactttactactgtcgaacggnggtacgttcggtttaccggtggtcgtttacggttttccg

SEQ ID NO: 349091 - DNA, 623 bp, Homo sapiens
  misc_feature: GZ8MTXP02HV3CK.45.37.D04.1.454.CMB.2.raw
  modified_base (367)..(367): a, c, t, g, unknown or other
  misc_feature (367)..(367): n is a, c, g, or t
  modified_base (399)..(399): a, c, t, g, unknown or other
  misc_feature (399)..(399): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaggcttctggctacaccttcaccgacgactatcctccactgggtgcgacacggcccctggacgaagggcttggagtggagtgggatggataccgaaacccctaacgaagtggtaggcaacaaactntgacacagtaattcgagggcgaggtcaccgangaccagggacacgtcatcagacacacgcctacagtgggagcctaggacgacaacgtactacggaacacgttaccgtacggaaaccggtacccgaaaccgggtaccttaaacgtttttaacgtttaaaccggttggtacgggtaacccgggtaggggttaaacgttttcgggggttttaacccgggtttcgggttaccggtttttcggggtttttttaaccccgg

SEQ ID NO: 349092 - DNA, 554 bp, Homo sapiens
  misc_feature: GZ8MTXP02GBI21.45.37.D04.1.454.CMB.2.raw
  modified_base (431)..(431): a, c, t, g, unknown or other
  misc_feature (431)..(431): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaggcttatggctacaccttcaccggcgactatcctccactggggtgcgacacggccccctggacgaagggcttgagtggagtgggatggatcaaccccctaacaagtggtggcaacgaaactatgacacgagaagttcgagggcagggtcaccgatgaccgaggacacgtcatcagcacacgcctaacngtagagctagacgacacgacgtgaccatctacggaccgacgaccggtacctaattttactaaccgtgtacgtaaccggaggtactttcgggtttaaccggtcggtcgtttcgggtttttcccg

SEQ ID NO: 349093 - DNA, 626 bp, Homo sapiens
  misc_feature: GZ8MTXP02I5YO8.45.37.D04.1.454.CMB.2.raw
  modified_base (293)..(293): a, c, t, g, unknown or other
  misc_feature (293)..(293): n is a, c, g, or t
  modified_base (344)..(344): a, c, t, g, unknown or other
  misc_feature (344)..(344): n is a, c, g, or t
  modified_base (363)..(363): a, c, t, g, unknown or other
  misc_feature (363)..(363): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctcgagtgaaggtctctgcaggcttctggctacaccttcaccggcgactatctccacgtgggtgcgacncggcccctggacgaagggcttggagtggatgggatggatacaacccctaanagtggtagacaacaaactntagcaacgagtaagttcgagggcgagggtacaacctagacggaaccgaaggggactaccgtacatacgacgcaaacacgaccctaacgagacgggacgtaccgagaacgccgaaaggtaacctggaaaccctagtaccgtaacggaacccgaaaccgaccgggtaacccttaattttaacgttaaaccgtggtacggtaaccgggtaaggttacgtttacgggtttaaccgggttcgggttcgtttacgggttttttacccgg

SEQ ID NO: 349094 - DNA, 557 bp, Homo sapiens
  misc_feature: GZ8MTXP02G5QME.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagcctggggcctcagtgaaggtctcctgcaaggcttctggctacaccttcaccggcgactatcctccactgggtgcgacacggccccctggacaaggctgagtggatgggatggatcgaaccccctaacaatggtggctaacgaaactatgacacaagaagtttacgaggggcgaggggtcaaccagtaggaaccgaggggacaccggtccaactcagccacagacctacatggagcgtgagcacggactcgacaattcgacgacgacaccggactaacgtttacttaacctgttcgaacggtagtacgttacgtttacggtcggtcgtttcggttttacccg

SEQ ID NO: 349095 - DNA, 572 bp, Homo sapiens
  misc_feature: GZ8MTXP02H8UL5.45.37.D04.1.454.CMB.2.raw
  modified_base (253)..(253): a, c, t, g, unknown or other
  misc_feature (253)..(253): n is a, c, g, or t
  modified_base (366)..(366): a, c, t, g, unknown or other
  misc_feature (366)..(366): n is a, c, g, or t
  modified_base (446)..(446): a, c, t, g, unknown or other
  misc_feature (446)..(446): n is a, c, g, or t
  modified_base (466)..(466): a, c, t, g, unknown or other
  misc_feature (466)..(466): n is a, c, g, or t
tcagacgcgatcgacacgaccggtgctcgatttagtagcatactgttgggtttgggggcatcaccccagcaaccacatctgtcctctagagaatccccctgagagctccgttcctcaccatggactggacctggaggatcctcttcttggtggcagcagccacaagagccccactccccaggtgcagctggtgcagtctggggctgaggtgaggaagccgtggggcctcagtgaaggtctctgcaaggcttcnggctacaccttcaccggcgactatctccacgtgggtgcgacacgggccccctggacaagggcttgagtggatgggatggatcaaacctaaccaagtggtcgacaacaaactangtacaacagtaagtttcgaggggcagggtacaacgatacgaccgagggacacgtcatcgagcaacagcctaacagtggancgtagagcgaagactgaacngtacgacgaccgacgcggtacctaagttttactacgtggttacgcggtaaggtacgttacggttttaccgggtggttaccggtttcggtttttaccgtttacgggg

SEQ ID NO: 349096 - DNA, 549 bp, Homo sapiens
  misc_feature: GZ8MTXP02GI7JS.45.37.D04.1.454.CMB.2.raw
  modified_base (285)..(285): a, c, t, g, unknown or other
  misc_feature (285)..(285): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
  modified_base (455)..(455): a, c, t, g, unknown or other
  misc_feature (455)..(455): n is a, c, g, or t
tcagacgcgatcgacacgaccggtgctcgatttagtagcatactgttgggtttggggcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggaagctggggcctcagtgaaggtctcctgcaaggcttctggctacaccttcaccggcgactatctccactggggtncgacacgggccccctggacaaggggcttggagtggagtggggatgggataccgaaacccctaacaagtggtggactaacaaaactatgcacaagtaagtttcgaagggcagggtcaccatcgacagggacacgtccatcagcacacgcctanatgganctgagcagtacngacatcagacgacacggacctaatttacttacgtcgttgacggaaggtacttacggtttacccggtggtccgtttcgggtttaccctttttggg

SEQ ID NO: 349097 - DNA, 529 bp, Homo sapiens
  misc_feature: GZ8MTXP02GJK1X.45.37.D04.1.454.CMB.2.raw
  modified_base (365)..(365): a, c, t, g, unknown or other
  misc_feature (365)..(365): n is a, c, g, or t
  modified_base (511)..(511): a, c, t, g, unknown or other
  misc_feature (511)..(511): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccacgtgggtgcgacacggcccctggacaagggcttggagtggagtgggatggactcaaaccccctaacaagtggtgcaacaaactntcgacaacgagtaagtttcgagggcagggtcaacctagcgacgagggacacgtacatcagcaacacgtcacgatcggagcagagcagactgacatcacgacgacaccggtctatttactacgtgtagcgtagtattcggttacggngtcgtttcggttttaccg

SEQ ID NO: 349098 - DNA, 508 bp, Homo sapiens
  misc_feature: GZ8MTXP02JMUKO.45.37.D04.1.454.CMB.2.raw
  modified_base (358)..(358): a, c, t, g, unknown or other
  misc_feature (358)..(358): n is a, c, g, or t
  modified_base (417)..(417): a, c, t, g, unknown or other
  misc_feature (417)..(417): n is a, c, g, or t
  modified_base (441)..(441): a, c, t, g, unknown or other
  misc_feature (441)..(441): n is a, c, g, or t
  modified_base (480)..(480): a, c, t, g, unknown or other
  misc_feature (480)..(480): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggctcagtgaaggtctcctgcaaggcttctggctacaccttcaccggcgactatctccactggggtgcgacaggcccctggacaagggcttgagtggatggggatggatcaaaccccctacaatggtggcaacaaactntgacacagaagtttcgagggcaaggggtcaaccatgaccagggacacgtccatcagcanagctacatggagctgagacagacngacatctacgacgacgacggacctacttattaactgtgngaggagtgttacggtcgtcgtcgtttcg

SEQ ID NO: 349099 - DNA, 589 bp, Homo sapiens
  misc_feature: GZ8MTXP02JZZ7A.45.37.D04.1.454.CMB.2.raw
  modified_base (258)..(258): a, c, t, g, unknown or other
  misc_feature (258)..(258): n is a, c, g, or t
  modified_base (370)..(370): a, c, t, g, unknown or other
  misc_feature (370)..(370): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaagcttctggctacnccttcgaccggcgactatcctccacgtgggtgcgacgacggccccgtggacgaagggcttggagtggagtgggatggactcaacccctaacgagtggtaggacaacaaactntcgacaacgagtagtttcgagggcgagggtaccacgagtacgacgagggacacgtcatcgagcacgacgaccctagacgtgggacgcgtagacggacaacgtaccgtggaactagtaccgtacggaaaccgaccgaccggtaccttaattttaacgtactggtacgcgtaaggttacgttacggtttaccggtcggttacggtttcggtttttacccgg

SEQ ID NO: 349100 - DNA, 522 bp, Homo sapiens
  misc_feature: GZ8MTXP02I8FCU.45.37.D04.1.454.CMB.2.raw
  modified_base (223)..(223): a, c, t, g, unknown or other
  misc_feature (223)..(223): n is a, c, g, or t
  modified_base (250)..(250): a, c, t, g, unknown or other
  misc_feature (250)..(250): n is a, c, g, or t
  modified_base (442)..(442): a, c, t, g, unknown or other
  misc_feature (442)..(442): n is a, c, g, or t
  modified_base (476)..(476): a, c, t, g, unknown or other
  misc_feature (476)..(476): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagctggggcctnagtgagtctctgcaagctctggctacnccttcaccggcgactatctccactggtgcgacacggcccctggacaagggcttgagtgatggatgatcaacccctaacaatggtgacacaaactgtgacaacgagtaagtttcaaggggtcaaggggtcgcccaatcggaaccgaaggggacacggtacacgtcagcaacacgacctacgagtggagctgancagactgacatctagacgacacggactacgtttntaaccgtgtcgaagagtagttcgttaccggtgtcgttggttttccg

SEQ ID NO: 349101 - DNA, 596 bp, Homo sapiens
  misc_feature: GZ8MTXP02GMZE4.45.37.D04.1.454.CMB.2.raw
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (369)..(369): a, c, t, g, unknown or other
  misc_feature (369)..(369): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagacgcccactcccaggtgcagctggtgcagtcgtggggctggaggtgaggaagccgtggggcctcagtgaaggtctctgcaggctngctacncctcaccggcgactatctccacgtggtgcgacgacggccccgtggacgaagggcttgaggtggagtgggatggatacgaaacccctaaacagtggtaggacaacaaaactntgacaacgaagtaagtttacgaaggggacgacggggtaccaaccgagacggaacccgaacggggaaccaccgtaccacacagacaacacgacctaacgagtaggacgcgtagagacgagtacagaacatacgacgaaccgacgaccggtaccttaatttagttaaccgtggtacggcggtaacggtagttacgggtttaccggtcggtccgtttcggtttttacccg

SEQ ID NO: 349102 - DNA, 590 bp, Homo sapiens
  misc_feature: GZ8MTXP02H1XV3.45.37.D04.1.454.CMB.2.raw
  modified_base (238)..(238): a, c, t, g, unknown or other
  misc_feature (238)..(238): n is a, c, g, or t
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (344)..(344): a, c, t, g, unknown or other
  misc_feature (344)..(344): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagacgcccactcccaggtgcagcgtggtgcagtcgtgggctggaggtgaggagcgtgggctgagtgagtctcngcagctcnggctacnccttcaccggtcgactatcctccacgtggtgccgacgacggcccctaggaacgaggtcttggagtggagtgggatggataccaaccctaanacgtggtacgacaacgaaactgtcgacaaccgtaagtaacgtttcgagggtacacggggtaccaaccgtagacggaaccgacggggaacacccggtacaacacgacgcaacgacgaccttaacgagtacggagtccgagacggacagactacggacattcgacgacgaacgaccggtacttaatttacgtacctggtacgaaggagttacggttcggtttacggtcggttcgtttcggttttaccg

SEQ ID NO: 349103 - DNA, 524 bp, Homo sapiens
  misc_feature: GZ8MTXP02IZDMZ.45.37.D04.1.454.CMB.2.raw
tcagacgcgatcgacacgaccggtgctcgatttagtagcatactgttggggtttgggggcatcaccccagcaaccacatctgtcctctagagaatccccctgagagctccgttcctcaccatggactggacctggaggatcctcttcttggtggcagcagccacaagagcccactccccaggtgcagctggtgcagtctgggggctgaggtgaggaagcctgggggcctcagtgaaggtctcctgcaaggcttctggctacacccttcaccggcgactatctccactggggtgcgacaggcccctggacaaggggcttgagtggatggggatggatcaaaccctacaatggtggcacaaactatgacacagaagtttcgagggcagggtcaccatgacgagggacacgtccatcagcacagcctacatggagctagacgcagactgacatcgtgaacgacacggcctaatttacttactcgtgcgaaggattcggttacggtggtcgttggtttccttttacgg

SEQ ID NO: 349104 - DNA, 522 bp, Homo sapiens
  misc_feature: GZ8MTXP02JIS9K.45.37.D04.1.454.CMB.2.raw
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (447)..(448): a, c, t, g, unknown or other
  misc_feature (447)..(448): n is a, c, g, or t
  modified_base (483)..(483): a, c, t, g, unknown or other
  misc_feature (483)..(483): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaggtcnctgcaggctcngctacnccttcaccggcgactatctccactggtgcgacacggcccctggacaagggcttgagtggatgggatggatcaacccctaacaagtggtacggactaacgaaactgtgacacgagtaagtttcgagggcaggggtcaaccagtcgaccgagggacacgtcatcagcacacgctacagtggagcngancagactgacnncgtacgacgacaccggctaactttatacgtgtcgnggtagtacttcggttacggtcggtcgttacggttttccg

SEQ ID NO: 349105 - DNA, 524 bp, Homo sapiens
  misc_feature: GZ8MTXP02IXCVX.45.37.D04.1.454.CMB.2.raw
  modified_base (358)..(358): a, c, t, g, unknown or other
  misc_feature (358)..(358): n is a, c, g, or t
  modified_base (477)..(477): a, c, t, g, unknown or other
  misc_feature (477)..(477): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatcctccactgggtgcgacaggcccctggacaagggcttggagtggatgggatggatcaacccctaacaatggtgcaacaaactntgcacagaagttcgagggcagggtcacatgaccgaggacacgtcactacagcacacgcctacgatgggagcgtagagcagactagacatcagacgacaccggacctaatttacttacgngtacgcgtaggacgttacggtttcggtcggtcgtttcggtttttccg

SEQ ID NO: 349106 - DNA, 683 bp, Homo sapiens
  misc_feature: GZ8MTXP02J2GQT.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccacgtggtgcgacacggcccctggacgaagggcttgagtggagtgggatggataccaaccccctaacgaatgggtacggacaacaaaactgtgaccaacgagtaaacgtttcgaaggggcaacggggtaccaacccgagtacgaaccgaaggggacctacgtaccatacgacgaccacgtacggaccctaacgagtagggacgtaccgtagaacggtaccaaagggtaccctagggaaaccgactttacccgtacggaaaaccccggaaccggaaacccgggtacccctttaaagtttttaacttaacccggttggtttacgggccggttaaacgggttaagtttccggggtttttaaaccccggggttgggttaccccggtttttcggggttttttaaccccgg

SEQ ID NO: 349107 - DNA, 633 bp, Homo sapiens
  misc_feature: GZ8MTXP02IPBMY.45.37.D04.1.454.CMB.2.raw
  modified_base (376)..(376): a, c, t, g, unknown or other
  misc_feature (376)..(376): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcctaggtgcagctggtgcagtcgtggggctgaggtgaggagccgtgggcctcagtgaggtctcctgcagtcttctggctacaccttcaccggcgactatcctccacgtggggtcgcgacgacggcccctgggaccgaaggggtcttggaggtggagtgggatggaactaccaaccccctaacagtggtacgaacaacaaactntcgacaacgaagtaacgttacgacggggtcaggggtacaccgtatacggaacgagggacaccgtaccacgtacacgcaacgaccgtacctaacgacgtagggacgtacgtaggacgacgaacgtacgtacggaacctagtaccgtaacggaaccggaaccaaccggggttacccttaatttttacgtaacgttgttaggaacggtaacggttagtttacgggtttaccgggtcggtttcggtttcggtttttaccgg

SEQ ID NO: 349108 - DNA, 526 bp, Homo sapiens
  misc_feature: GZ8MTXP02ITQN6.45.37.D04.1.454.CMB.2.raw
  modified_base (225)..(225): a, c, t, g, unknown or other
  misc_feature (225)..(225): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctnagtgaggtctcctgcaaggctctggctacaccttcaccggcgactatctccactggtgcgacaggcccctggacaagggctggagtggatgggatggatcaacccctaacaatggtggacacgaaaactgtgcacagtaagtttcgaaggggcagggtcaacgagtgaaccgagggacacgtccatcagcacagcctacatggagactgacgcaggactgacatctagacgacacggacctatttacgttactgtacgcgtaggtacttacggttaccggtcggtcgttcggtttttaccg

SEQ ID NO: 349109 - DNA, 624 bp, Homo sapiens
  misc_feature: GZ8MTXP02FWV7C.45.37.D04.1.454.CMB.2.raw
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcgagtgaaggtctcctgcaggcttcnggctacncctcaccggcactatcctccacgtgggtgccgacgacggcccccgtggacgaagggtcttggaggtggagtgggatggaactaccaaaccccctaacaagtgggtacggacaaccaaaacttgcgacaacgtaagtaacgtttcgaaggggtctacggggtacaacccgagtacgaacccgagggaccacgtaccagtcacgcaaccacgacctaacgagtacgggacgtacgtaggaacgacgaagtaccgtagaacctagtcgtacggaaccgaccgaccggtaccttaattttacgttacgtggtacggcggtaaggtacgtttacgggttaccggtcggttacgtttcggtttttacccg

SEQ ID NO: 349110 - DNA, 603 bp, Homo sapiens
  misc_feature: GZ8MTXP02J0HOV.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatcctccacgtggtgcgacgacggccccgtggacaagggcttgagtggatgggatggatacaaccccctaacaagtggtacggacaacgaaaactgtgacacgagtaacgtttcgaggggtcgaggggttcaccgagtacggacccgaacggggaccaccgtaccaatccagaccaacgacgccctaacgagtacgggacgacgtagacgacgacgactacggactatcgtacggaaccgaccgaccgggacccttaagtttacttacgtcgtgaacgggtaaggtacgtttacggttaccggttcggtccgtttcggtttttacccgg

SEQ ID NO: 349111 - DNA, 535 bp, Homo sapiens
  misc_feature: GZ8MTXP02HW9XJ.45.37.D04.1.454.CMB.2.raw
  modified_base (316)..(316): a, c, t, g, unknown or other
  misc_feature (316)..(316): n is a, c, g, or t
  modified_base (423)..(423): a, c, t, g, unknown or other
  misc_feature (423)..(423): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctacctaagcctgctctatttacngggcatccgtaccccgggaatccggggtccccctgaccgtattcagtggcaggcgggtctgggaccagtatttcactctcaccatcagcacgcctgcagctagaaangtgtggctagtttatgtctgtacagctaaatattattattacttcctaccgtactttccgcctacggacctaaagtagtaagtaactacaaacgtaactcgtacggtctacg

SEQ ID NO: 349112 - DNA, 555 bp, Homo sapiens
  misc_feature: GZ8MTXP02H9V04.45.37.D04.1.454.CMB.2.raw
  modified_base (346)..(346): a, c, t, g, unknown or other
  misc_feature (346)..(346): n is a, c, g, or t
  modified_base (363)..(363): a, c, t, g, unknown or other
  misc_feature (363)..(363): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagcctgggggcctcgagtgaaggtctcctgcaaggcttctggctacaccttcaccggcgactatcctccacgtgggtgcgacacggcccctggacaagggcttggagtggatgggatggatcgaacccctanagtggtgacacaaactntgcacgagtagtttcgagggcagggtcaccagtcgaccgagggaccacgtccatcagcacacgcctacgatagggacgctggacgcaaggtaccagactatccgaggaccgaccgaccggtacctagtttactacgtgtgaacgtaaggtacgttacggtttaccgggtcggttacgttcgggtttttaccg

SEQ ID NO: 349113 - DNA, 527 bp, Homo sapiens
  misc_feature: GZ8MTXP02JOSU4.45.37.D04.1.454.CMB.2.raw
  modified_base (428)..(428): a, c, t, g, unknown or other
  misc_feature (428)..(428): n is a, c, g, or t
tcagacgcgatcgacacgaccggtgctcgatttagtagcatactgttgggtttgggggcatcaccccagcaaccacatctgtcctctagagaatccccctgagagctccgttcctcaccatggactggacctggaggatcctcttcttggtggcagcagccacaagagcccactccccaggtgcagctggtgcagtctgggggctgaggtgaggaagcctgggggcctcagtgaaggtctcctgcaaggcttctggctacaccttcaccggcgactatctccactgggtgcgaccaggccccctggacaagggcttgagtggatgggatggatcaaccctaaccaatggtgacacaaactatgcaacagtagttcagggcagggtcaccatcgaccgagggacacgtccatcgagcaacagcctacgngtaggagcgtagagcagactgaccatcgacgaacgacacggacctatttactacgtgtagcgtaagacttcgttacggtgtcgttcggtttcctttagg

SEQ ID NO: 349114 - DNA, 597 bp, Homo sapiens
  misc_feature: GZ8MTXP02FR6N5.45.37.D04.1.454.CMB.2.raw
  modified_base (318)..(318): a, c, t, g, unknown or other
  misc_feature (318)..(318): n is a, c, g, or t
  modified_base (376)..(376): a, c, t, g, unknown or other
  misc_feature (376)..(376): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctaccaaacaataagaactactagcttaggtaccagcaagaaaccaggtcagcctacctaagctgctctatttacgngggcatccgtaacccgggaactcccggggtccccctagacccgtattccgagtcggcngggcgggtcgtggggacagtactttcacctctacaccctatcagcacgcctgcaggctagaaagtagtcggtggacttagtttagtgtcctgtaccagtactaattatttaattacttacttcccgttaccgttacgtttccggcccgttacgggtaaaccctaaaggttacggaacttaacgtaaccgtaaaacgtacgttacggtcggtacttaaccgg

SEQ ID NO: 349115 - DNA, 555 bp, Homo sapiens
  misc_feature: GZ8MTXP02IOXAT.45.37.D04.1.454.CMB.2.raw
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
  modified_base (459)..(459): a, c, t, g, unknown or other
  misc_feature (459)..(459): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatctccactgggtgcgacaggccccctggacaagggcttgagtggatgggatggatcaacccctanaatggtggcaacgaaactntacgacaacgagtaagtttcgaggggcagggtcaaccagtcgaccgagggacacggtccatcacgacacacgacctacagtggacgcgtgagacaggacngacatctagaaccgacgaccggtcctaattttacttacgtgtggaaccgtaggtacgttacggtttaccgggtcggtacgtttacggtttttccgg

SEQ ID NO: 349116 - DNA, 605 bp, Homo sapiens
  misc_feature: GZ8MTXP02GFBOE.45.37.D04.1.454.CMB.2.raw
  modified_base (319)..(319): a, c, t, g, unknown or other
  misc_feature (319)..(319): n is a, c, g, or t
  modified_base (365)..(365): a, c, t, g, unknown or other
  misc_feature (365)..(365): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttagacagctaccaaacaataagaactacttagcttggtaccagacaagaaaccaggtcagcctacctaagctgctcatttacnggcatcgtacccggaatccggggtcccctgaccgtattcagtggcnggcgggtctgggacagtatttcactctcaccatcagcagccctgccaggctagaaagtagtggtcgggtactaggtttattgccttgtacagtactaaagttatttaatttaacttactttacccgttacccggttaccgttttacccggaccccgttacggggtaaaccctaaaaggtttggaaacttttaaacgaaccgttaaaaaccggtaaccgtttaggtacggtacttaaccgg

SEQ ID NO: 349117 - DNA, 605 bp, Homo sapiens
  misc_feature: GZ8MTXP02J0BVK.45.37.D04.1.454.CMB.2.raw
  modified_base (384)..(384): a, c, t, g, unknown or other
  misc_feature (384)..(384): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctgaggtgaggaagccgtggggcctcgagtgaaggtctcctgcaaggcttctggctacaccttcgaccggcgactatcctccacgtgggtgccgacgacggcccccgtggaccgaagggcttggagtgggagtgggatggacgtaccaaacccccgtaacaagtgggtacggacaacaaactntgacaacagtaacgtttcgagggcgagggtacaccagtacgaccgagggacacgtccatcagacacgacgacctacagtaggacgcgtagagacgagacgtagactacgtcctacggaaccgacgaccggtaccttaagttttacgtaacgtcggtacgtaacggtaaggtacggtttacgggttttaccgggtcggttccggtttacggtttttacccgg

SEQ ID NO: 349118 - DNA, 552 bp, Homo sapiens
  misc_feature: GZ8MTXP02GFUQ8.45.37.D04.1.454.CMB.2.raw
  modified_base (250)..(250): a, c, t, g, unknown or other
  misc_feature (250)..(250): n is a, c, g, or t
  modified_base (367)..(367): a, c, t, g, unknown or other
  misc_feature (367)..(367): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttcnggctacaccttcaccggcgactatcctccactgggtgcgacacggcccctggacaaggggcttggagtggagtgggatggatccaaaccccctaacaagtggtcggacaacaaactntgacaacagtaagtttcgaggggcaggggtcaccatcgaaccaggggacaccggtccatcagcaacacgccctacagtggagctgacgacagactgacatctacgacgacgacggtcctaatttactacgtgtagaacggtagtacgttacggtttaccgggtggttcggtttacggtttttccg

SEQ ID NO: 349119 - DNA, 574 bp, Homo sapiens
  misc_feature: GZ8MTXP02INJCN.45.37.D04.1.454.CMB.2.raw
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagccccactccccaggtgcagctggtgcagtctgggggctgaggtgaggaagccgtgggggcctcagtgaaggtctcctgcaaggcttctggctacaccttcaccggcgactatctccactgggtgcgacagggccccctggacaagggcttggagtgggatggggatgggatacaacctaacagtggtggacaacaaaactatgacacgagtaagtttcgagggcagggtcacatagaccagggacacgtaccatcagcacacgccctaagagtaggacgtcgtaggacgacaaggtactacggaactaactcgacgaacgacgaccggcctaatttacttacgtgtacggacggtaaggtcgttacggtttaccggtggttccgtttacggttttccttttacggg

SEQ ID NO: 349120 - DNA, 541 bp, Homo sapiens
  misc_feature: GZ8MTXP02GMNFV.45.37.D04.1.454.CMB.2.raw
  modified_base (313)..(313): a, c, t, g, unknown or other
  misc_feature (313)..(313): n is a, c, g, or t
  modified_base (361)..(361): a, c, t, g, unknown or other
  misc_feature (361)..(361): n is a, c, g, or t
  modified_base (415)..(415): a, c, t, g, unknown or other
  misc_feature (415)..(415): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttacngggcatcgtacccgggaatccggggtcccctgaccgattcagtcggcngcgggtctggggacagtacttcactctcaccatcagcagcctgcagctgaaagntgtggctagtttatgctgtacagtactaattattattaattactttccctacgtaccgttttccggcccgtacgggaaaccctaaagtcggaatactaaccgaaaacgacttggtacggtactacg

SEQ ID NO: 349121 - DNA, 602 bp, Homo sapiens
  misc_feature: GZ8MTXP02JX430.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctgaggtgaggagccgtggggcctcagtgaaggtctcctgcaaggcttcgtggctacaccttcaccggcgactatcctccacgtgggtgcgacgacggcccctggacaagggcttggaggtggagtggggatggactaccaaaccccctaacgaagtggtacggacaacgaaactgtgacaacgagtaagtttcgagggcagggtcacagtcgaccgaggacacgtccatcgagacacgacgaccctagagtaggagactagacgacgaagacctagaactagtcgacgaaccgaccgaaccggtacccttaaattttaacgttaccgtggttacgaaccgggttaaggttacgtttacgggtttaccgggtcggtttcccgtttacgggttttttacccg

SEQ ID NO: 349122 - DNA, 526 bp, Homo sapiens
  misc_feature: GZ8MTXP02GRJAW.45.37.D04.1.454.CMB.2.raw
  modified_base (358)..(358): a, c, t, g, unknown or other
  misc_feature (358)..(358): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatctccactgggtgcgacacggcccctggacaagggcttgagtggatgggatggatcaaaccccctaacatggtgcaacaaactntgcacagtaagttcgagggacagggtcaccatcgaccagggacacgtcatcagcacagacctacagtggagctagagcaggactgacatcgtacgacgacaccggtacctaatttacttacgtgtgcgtaggtacttcggttaccggtggtccgtttaggtttttccg

SEQ ID NO: 349123 - DNA, 532 bp, Homo sapiens
  misc_feature: GZ8MTXP02F47OH.45.37.D04.1.454.CMB.2.raw
  modified_base (289)..(289): a, c, t, g, unknown or other
  misc_feature (289)..(289): n is a, c, g, or t
  modified_base (431)..(431): a, c, t, g, unknown or other
  misc_feature (431)..(431): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtncgacacggcccctggacagggcttgagtggatggggatggatacccaaaccctaacaagtgggtaggaccaacaactatgacacagtaagtttcgagggcgaggtcacatcgacgaggacacgtcatcagcacacgcctaanagtaggagctagagacagactgacgattcgacgacgacgacggtacctactttacttacgtagtgacgtaggtacgttcggtttaccggtgtcgtttcggg

SEQ ID NO: 349124 - DNA, 550 bp, Homo sapiens
  misc_feature: GZ8MTXP02HQTJG.45.37.D04.1.454.CMB.2.raw
  modified_base (226)..(226): a, c, t, g, unknown or other
  misc_feature (226)..(226): n is a, c, g, or t
  modified_base (361)..(361): a, c, t, g, unknown or other
  misc_feature (361)..(361): n is a, c, g, or t
  modified_base (445)..(445): a, c, t, g, unknown or other
  misc_feature (445)..(445): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctnagtgaaggtctcctgcaaggcttctggctacaccttcaccggcgactatctccacgtgggtgcgacacggcccctggacaagggcttgagtggatgggatggataccaacccctaacaagtggtcggcacaaatntgcacagtaagttcgagggtcgagggtcaccgatacgacgagggacacggtccagtcagcacgacgcctaacgagtcggagcgngacgcagaccagacatcgacgaacgacgacggaccttaagtttactacgttggtcgaacggtaggtacgttacggtttacggtcggtcgtttacggtttttccgg

SEQ ID NO: 349125 - DNA, 578 bp, Homo sapiens
  misc_feature: GZ8MTXP02GBIQT.45.37.D04.1.454.CMB.2.raw
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaggtctcctgcaaggcttctggctacaccttcaccggcgactatcctccactgggtgcgacacggcccctggacaagggcttgagtggatgggatggataccaaaccctaacaagtggtaggacaacaactatgacacgtagtaagtttcgaaggggcgagggtccaaccgagtacgaaccgaaggggaccaccggtaccagtaccgacgaccacgacgacccgttaacgagtacgggagccgtaggacgacgaacgactagaactacttacgtacgaacgaaccgacggccctaagtttactacgtgtaagtacgaggtacttcggttaccggtggtcgttttcgg

SEQ ID NO: 349126 - DNA, 609 bp, Homo sapiens
  misc_feature: GZ8MTXP02F61CX.45.37.D04.1.454.CMB.2.raw
  modified_base (318)..(318): a, c, t, g, unknown or other
  misc_feature (318)..(318): n is a, c, g, or t
  modified_base (367)..(367): a, c, t, g, unknown or other
  misc_feature (367)..(367): n is a, c, g, or t
  modified_base (376)..(376): a, c, t, g, unknown or other
  misc_feature (376)..(376): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaaacaataagaactacttagcttaggtaccagacaagaaaccaggtcagcctcctaagctgctctatttacgnggcatccgtacccgggaagtccggggtcccctgaccgattcgagtggcnggcgggtcngggacagtatttcactctcaccatcagcagccctagcaggactagaaacgtagtggtaggtacttagtttttagcgcttaggacctaagactaaatttattaattacttacgttcccgttaccgttaaccgttttccgggaccccgttaagggggaaaaccctaaaagggttcggaaaacttaacgttaaaccgtaaaaacggttaacgttacgggttcggacctttaaccgg

SEQ ID NO: 349127 - DNA, 498 bp, Homo sapiens
  misc_feature: GZ8MTXP02JR7UH.45.37.D04.1.454.CMB.2.raw
  modified_base (423)..(423): a, c, t, g, unknown or other
  misc_feature (423)..(423): n is a, c, g, or t
  modified_base (441)..(441): a, c, t, g, unknown or other
  misc_feature (441)..(441): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccatggacaagggcttgagtggatgggatggatccaaccctacaatggtggcacaactatgcacagaagtttcagggcagggtcaccatgaccagggacacgtccatcagacacagcctacatggganctgagcagactgacatcngacgacacggcctatttactactgtgcgaggtactaggtttaccggtggtctttcgg

SEQ ID NO: 349128 - DNA, 639 bp, Homo sapiens
  misc_feature: GZ8MTXP02IFNIR.45.37.D04.1.454.CMB.2.raw
  modified_base (257)..(257): a, c, t, g, unknown or other
  misc_feature (257)..(257): n is a, c, g, or t
  modified_base (358)..(358): a, c, t, g, unknown or other
  misc_feature (358)..(358): n is a, c, g, or t
  modified_base (460)..(460): a, c, t, g, unknown or other
  misc_feature (460)..(460): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctgaggtgaggagccgtgggctcagtgaggtctcctgacaggcttcgtggctacnccttcaccggcgactactctccgacgtgggtgcgacgacggcccccgtaggaacagggtcttggaggtggagtgggagtggactaccgaaaccccctaaanaagttggacggacaacaaacgtgtacgacaacgtaagtaagttacgaggggtaccgacgggtaccacgtacgtacgaaccggaacggaccgaccgtacaacncgacgacaacgacgtacctaacgagtcgggagccgtagacgacgagacgtacgaactacgttcgtaacggaaccgaaccgaaccggtacccgttaaagtttttacttaaccgttggtaggaaccggtaggttacgtttcgggtttaaccggttcggtttccgtttcggtttttacccgg

SEQ ID NO: 349129 - DNA, 534 bp, Homo sapiens
  misc_feature: GZ8MTXP02FWVTH.45.37.D04.1.454.CMB.2.raw
  modified_base (234)..(234): a, c, t, g, unknown or other
  misc_feature (234)..(234): n is a, c, g, or t
  modified_base (352)..(352): a, c, t, g, unknown or other
  misc_feature (352)..(352): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaggtcncctgcaggcttctggctacaccttcaccggcgactatctccactgggtgcgacaggcccctggacaagggcttgagtggagtgggatggatcaacccctacaatggtgacacaaactntgcacgagtaagtttcgagggcagggtcaccatgaccagggacacgtcatcagcacagcctacgatggagctagacgcagtactgaacatcgtagacgacgaccggaccttaagtttacttactggtacgaacggtaggtacgttacggtttaacccggtggtccgtttcggtttttacccg

SEQ ID NO: 349130 - DNA, 598 bp, Homo sapiens
  misc_feature: GZ8MTXP02IANZT.45.37.D04.1.454.CMB.2.raw
  modified_base (385)..(385): a, c, t, g, unknown or other
  misc_feature (385)..(385): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcgagtgaaggtctcctgcaaggtcttcgtggctacaccttcgaccggcgactactcctcctacgtgggtcgcgacgacggccccctgggaaccaagggtcttggaggtggagtgggatggactacgaaaccccctaacaagtgggtgacaacaaactntgacaacgagtaacgttcgagggtcagggtcaccgagtcgaccgagggacaccgtcatcgagcacgacgcctaacgagtaggagcgtagagcgagtacgagactagtactacggaaccgaccgaccggtaccttaattttacgtaacgttggtacggaacggtaagggtacgtttacgggtttaccggtcggttccgtttcggtttttcccgg

SEQ ID NO: 349131 - DNA, 569 bp, Homo sapiens
  misc_feature: GZ8MTXP02JR9CV.45.37.D04.1.454.CMB.2.raw
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaggtctcctgcaggcttcgtggctacaccttcaccggcgactatctccacgtgggtcgccgacgacggcccctggacgaagggcttggagtggagtgggatggactacccaaccgtaanagtggtgacaacatangacanagtaagttcgagggcgaggtcacgagcgacgaggaccacgtacatacacgacacgacgaccctagacgtaggacgcgtagacgacgacgacgtagacacgttcgacgaccgacgaccggtaccttaagttacgttaagtggtaagtaaggtacggttacgttacgggtttaccggtcgggttcgttttacggg

SEQ ID NO: 349132 - DNA, 574 bp, Homo sapiens
  misc_feature: GZ8MTXP02HS3Z4.45.37.D04.1.454.CMB.2.raw
  modified_base (227)..(227): a, c, t, g, unknown or other
  misc_feature (227)..(227): n is a, c, g, or t
  modified_base (379)..(379): a, c, t, g, unknown or other
  misc_feature (379)..(379): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctggaggtgaggaagctggggcctnagtgaaggtctcctgcaaggcttctggctacaccttcaccggcgactatcctccacgtgggtcgcgaccgacggccccctggacgaagggtcttggagtggagtgggatgggactaccaaaccccctaacgaagtggtaggacaacaaactntgacacgagtaagttcgagggcgagggtcaccgatacgacgagggacacgtccagtcagcaacgacgacctacgaagtgggaacgctaggagccaagactagactatcgtacgaaccggacaccggtctaattttacgtacgtggtacgaacggtaggtaacgtttcggtttaccggtgtcgtttcggttttccg

SEQ ID NO: 349133 - DNA, 618 bp, Homo sapiens
  misc_feature: GZ8MTXP02IN05R.45.37.D04.1.454.CMB.2.raw
  modified_base (291)..(291): a, c, t, g, unknown or other
  misc_feature (291)..(291): n is a, c, g, or t
  modified_base (351)..(351): a, c, t, g, unknown or other
  misc_feature (351)..(351): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctgagtgaaggtctctgcaaggcttctggctactaccttcaccggcgactatcctccagtgggtncgacgacggcccctggacgaagggcttggagtggagtgggatggatacccaaaccctaanaagtgggtgacaacaactgtagacaacaagtaagtttacgacgggcgaacggggtaccaaccgagtacggaacccgacgggacaacccgtaccaactaccgaacgaccaaccgaacgtacccttaacgagtggaacgcgtagacgacaggacagaccagtaccgtacgaccgaacgaccggtaccttaagtttaacgttaccgtaggtcgtacggtaagggttacgttaccgggttttaccgggtcggtttaccgtttttcccgggg

SEQ ID NO: 349134 - DNA, 727 bp, Homo sapiens
  misc_feature: GZ8MTXP02J28IY.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctcctgcaaggcttcgtggctacaccttcgaccggcgactactcctccgacgtggggtgaccggaccgacggcccccgtaggaaccgtaaaggggtccttaggaggttgggtagtggggaacttacgggactaccctaaacccccgtaaacgtaagtcggggttacggaccaaaccgtaaacttcgtacgaccaaaccgtaagttaacggtttacccggaaggggtccgaacgggggttaccaaccgaagttacggaaccccggaagggacccgaccgttaccacgtaccgagaccaaccgttacgacccgtacgagtacgggacgttacgtacggacgacgaacggttacgtacggaaacctaacgttcgtaacggacccgaaccgtaacccggtacctttaatttttacgaccgtttggacggtaaccggttaggtaacgttttcgggtttaaccggggcgtttaccggtttacgggtttttacccgg

SEQ ID NO: 349135 - DNA, 769 bp, Homo sapiens
  misc_feature: GZ8MTXP02J3FN3.45.37.D04.1.454.CMB.2.raw
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatcctccacgtgggtgcgacacggccccctaggaccgaaggggtcttggaggtggagtggggagtggaactacccgaaaccctaacgaaagtggtacggaccaaactaaccgtagtacgaccaaacgtaacgtaaacggttttacgaacgggggaccgtaaacgggggttacccaaaccccgtaagttacccgggaaaccccgtaacggggggtaaaccccaaacccggggttaccccaaaccgttaccgaaaaccgggaccctaaacccgaaccgggaccccctttaaaccgacgttagggggaaaccgtccgtagggaaacggaccgtaaacgggtaaccttacggaaaaccctaagtttacccggtaacggaaacccggaaccggtaaccgggtaacccttaaattttaaccgtttaaacgtaccgggttggaccgggtaaggttacgtttacggggtttaacccgggttaggttacgtttttaccgggg

SEQ ID NO: 349136 - DNA, 702 bp, Homo sapiens
  misc_feature: GZ8MTXP02FXZCY.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagttgtttagacagctaccaaacaataaagaacttactagcttaggtaccagacaagaaaccaggtcacgcctactaagctgctctatttacgtggctacgtccgtacccgggaacgtcccggggtcccctacgacccgtagttccgagtcggactcggggccgggtcgtacggggactagtactttaccaaccttctaccacccataccacgcacgcccgtaggaccaagggacctaggaaaagtcgttgggtacgggtacctttaagggttttacgtcggtacttacggttacgaaacgttacttaaaagttaacttttaaatttaaacgtttaaccttttccccggtacccggtttaacccgttttacccggggaaccccgtttaggggtaaaaaccctaagggttacggtaaaacttaaacgttaaaccgaaaaaacccggtctttacggggtacggtaccgttaacg

SEQ ID NO: 349137 - DNA, 654 bp, Homo sapiens
  misc_feature: GZ8MTXP02H6Z4W.45.37.D04.1.454.CMB.2.raw
  modified_base (250)..(250): a, c, t, g, unknown or other
  misc_feature (250)..(250): n is a, c, g, or t
  modified_base (292)..(292): a, c, t, g, unknown or other
  misc_feature (292)..(292): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagctggggcctcagtgaaggtctcctgcaaggcttcnggctacaccttcaccggcgactatctccacgtgggtgcgacncggcccctggacgaagggcttggagtgggatggggatggactacaaaccccctaaacaaagtgggtaggacaacaaaacctataggacaaccgaagtaaagtttcgagggtcgaacggggtacaaccgatacggaaccgagggggaccacggttaccaacgtacacgacaaacgacgaccttaacgagtagggacgcgagacgacgaacgacgttacgactacgttaccgtacggaaccgaaccgaaccgggtacccttaaagtttttaacttaaccgttggttacggaaccggtaagggtaacgtttacgggttttaacccggggtcgggtttaaccgttttcggggttttttaacccggg

SEQ ID NO: 349138 - DNA, 581 bp, Homo sapiens
  misc_feature: GZ8MTXP02HEX6P.45.37.D04.1.454.CMB.2.raw
  modified_base (288)..(288): a, c, t, g, unknown or other
  misc_feature (288)..(288): n is a, c, g, or t
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccagtgcagctggtgcagtctggggctgaggtgaggaagccgtggggcctcagtgaaggtctcctgcaaggcttcgtggctacaccttcgaccggcgactatctccactgggngcgacgacggccctggaacgaagggtctggagtggagtgggatggatacaaaccccccgtaanaagtgggtacggacaacaaactntcgacaacgagtaagtttcgagggtcaggggtacacccaagtcgaccgtaagggacaccgtaccgataccgagacacaggaccctacgagtcgggagactagacgacaggtacagacagtcgtacgaacgacgaccggtacctaattttactacgtcgttggaacgtaaggcgttacggtttacggcgttacgtttcggttttcccg

SEQ ID NO: 349139 - DNA, 551 bp, Homo sapiens
  misc_feature: GZ8MTXP02HF7LS.45.37.D04.1.454.CMB.2.raw
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctacaacaataagaactacttagcttggtaccagcaagaaaccaggtcagcctcctaagctgctcatttactggcatctacccgggaatccggggccccctgaccatcagtggcnggcgggtctggggacngtactttcactctcaccatcagcagccagcagctgaaagntggngntagtttntgctgtanagactaaattaatttattaacttacttcccgtaccgtaccgtttccggacccgtacgggaaacctaaaggttacggtaattaacgtaacgtaaaacgtacgtacggtacggacgtcg

SEQ ID NO: 349140 - DNA, 556 bp, Homo sapiens
  misc_feature: GZ8MTXP02H25G0.45.37.D04.1.454.CMB.2.raw
  modified_base (459)..(459): a, c, t, g, unknown or other
  misc_feature (459)..(459): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggaagctggggcctcagtgaaggtctcctgcaaggcttctggctacaccttcaccggcgactatctccactgggtgcgacaggcccctggacaagggcttgagtggatgggatggatacaaaccccctaacaaagtggtggacaacaaaactataggacaacaagtaaatttcgaagggcgaagggtacaacccgatacgaaccaaggggacacggtacccaatccagacacacgcctaacatggganctgagcaggacngactancgtacgaacgacacgactaatttactacgtgtagaacggtaaggtacgttacggttacggtcgttacgtttcggtttcg

SEQ ID NO: 349141 - DNA, 661 bp, Homo sapiens
  misc_feature: GZ8MTXP02I0AO4.45.37.D04.1.454.CMB.2.raw
  modified_base (257)..(257): a, c, t, g, unknown or other
  misc_feature (257)..(257): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggagccgtggggcctcagtgaaggtctctgcaaggcttctggctacnccttcaccggcgactatactccacgtgggtgcgacgacggcccctaggacgaagggcttggagtggagtgggatggatcaaaccccctaacaagtggtaggacaacaaactgtgacaacaagtacgtttacgaggggcaaggggtccaacccgagtacggaacccgaagggggaaccacccggttaccaagtaccgaacgaccaacgaccggacccttaacgagtacgggacgaccgaggaacggccgaaggaaccttaggaaaacctcgttaccgtaacggaaccggaaacccgtaaccggggtaccctttaaaggtttttactaaccggttgttaggaacggtaacgggttaagtttcggggttttaacccggtgggttccggttttacggttttttcccgg

SEQ ID NO: 349142 - DNA, 535 bp, Homo sapiens
  misc_feature: GZ8MTXP02HJ735.45.37.D04.1.454.CMB.2.raw
  modified_base (311)..(311): a, c, t, g, unknown or other
  misc_feature (311)..(311): n is a, c, g, or t
  modified_base (418)..(418): a, c, t, g, unknown or other
  misc_feature (418)..(418): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtaccagcagaaaccaggtcagcctctaagctgctcatttacngggcatctacccgggaatccggggtcccctgaccgattcagtggcaggcgggtctggggacagtatttcactctacaccatcagcagcctgcaggctagaaagatgnggtctagtttatgctgtcagctaattattattaattacttcctaccgtacgtttccggaccctagggaaccctaaagtcggaatacgtaacgaaaacgtaactggtacggtactacg

SEQ ID NO: 349143 - DNA, 556 bp, Homo sapiens
  misc_feature: GZ8MTXP02J2DWH.45.37.D04.1.454.CMB.2.raw
  modified_base (375)..(375): a, c, t, g, unknown or other
  misc_feature (375)..(375): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttcgtggctacaccttcaccggcgactatctccactgggtgcgacacggcccctggacaagggcttggagtggatgggatggactaccaaaccccctaacaaagtgggtacggacaacctaaaactntaggacaacgagtaagtttcgagggtcaggggtcacatgaccgagggacacgtcatcagcacagcctacagtggacgctagagtacagactgacatcgagaaccgacaccggacctaagtttactaccgtggtacgcgaaggtacgttcggtttaccgggtcggtcgtttacggttttccg

SEQ ID NO: 349144 - DNA, 615 bp, Homo sapiens
  misc_feature: GZ8MTXP02H09YB.45.37.D04.1.454.CMB.2.raw
  modified_base (451)..(451): a, c, t, g, unknown or other
  misc_feature (451)..(451): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtggggcctgagtgaaggtctcctgcaaggcttctggctacaccttcaccggcactactcctccacgtggggtgcgacacggccccctggacgaaggggctttggaggtggagtggggatggactacccgaaaccctaacaagtggggtcggacaacgaaactagtgacaacgaagtaagtttacgagggacgagggtaccaacgtagacgaccgaggggaccacgtaccancgagcaacacgacctaacagtagggagacgtagacgacgaacggactacgaacacgttacgacggaaaccgacgaaccggtacccttaaatttacgtttaaccgtgtaacgggtacggtaaggttacgttcgggtttaacccgggtgttaccggtttttccggg

SEQ ID NO: 349145 - DNA, 555 bp, Homo sapiens
  misc_feature: GZ8MTXP02HBKLI.45.37.D04.1.454.CMB.2.raw
  modified_base (294)..(294): a, c, t, g, unknown or other
  misc_feature (294)..(294): n is a, c, g, or t
  modified_base (355)..(355): a, c, t, g, unknown or other
  misc_feature (355)..(355): n is a, c, g, or t
  modified_base (372)..(372): a, c, t, g, unknown or other
  misc_feature (372)..(372): n is a, c, g, or t
  modified_base (421)..(421): a, c, t, g, unknown or other
  misc_feature (421)..(421): n is a, c, g, or t
  modified_base (426)..(426): a, c, t, g, unknown or other
  misc_feature (426)..(426): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcgagtgaaggtctcctgcaaggcttcgtggctacaccttcgaccggcgactatcctccactgggtncgacacggcccctggacgaagggcttggagtggatgggatcggatacccgaaaccctaaanagtggtagacaacaatncacagagtaacgtacgaggacgaggacacagacgacgagactacgacanacganacacacgtacctagagaggagacgagacgacgacgacgacgacacgtacgtacgacgacgacgtactacttacgttacgtacgtaacgtacgtacggtacgttacggttacggttacggttacgtttcg

SEQ ID NO: 349146 - DNA, 522 bp, Homo sapiens
  misc_feature: GZ8MTXP02GTEVY.45.37.D04.1.454.CMB.2.raw
  modified_base (316)..(316): a, c, t, g, unknown or other
  misc_feature (316)..(316): n is a, c, g, or t
  modified_base (425)..(425): a, c, t, g, unknown or other
  misc_feature (425)..(425): n is a, c, g, or t
tcagacgcgatcgacacgaccggtgctcgatttagtagcatactgttgggtttgggggagctaaaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctaccaaacaataagaactacttagcttggtaccagcaagaaaccaggtcagcctcctaagctgctcatttacngggcatccgtaacccggggaatcccggggtcctcgaccgattcagtggcaggcgggtctgggacagtattcactctcaccatcagcagccctgctaggctagaagatgnggctagtttatgctgtcagctaattattattatacttcctcgtacttcggccctagggaccaaagtcgaataacgacaaaacgactgtcgctagacc

SEQ ID NO: 349147 - DNA, 540 bp, Homo sapiens
  misc_feature: GZ8MTXP02J1GIN.45.37.D04.1.454.CMB.2.raw
  modified_base (358)..(358): a, c, t, g, unknown or other
  misc_feature (358)..(358): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctgaggtgaggaagcctggggcctcagtgaaggtctcctgcaaggcttctggctacaccttcaccggcgactatctccactgggtgcgacacggcccctggacaagggcttgagtggatgggatggatcaacccctaacatggtggacacaaactntgacacagtaagtttcgaagggtcaggggtccacagtagaccgagggacaccgtcactcgacgcactacgacctacgagttacgggagcgtagagccaagacagacactcgtcgacgaccgacggacctatttactacgtgtacgcgaggtagtcggtttacggtcggtcgttggttttccg

SEQ ID NO: 349148 - DNA, 510 bp, Homo sapiens
  misc_feature: GZ8MTXP02GOUPV.45.37.D04.1.454.CMB.2.raw
  modified_base (290)..(290): a, c, t, g, unknown or other
  misc_feature (290)..(290): n is a, c, g, or t
  modified_base (438)..(438): a, c, t, g, unknown or other
  misc_feature (438)..(438): n is a, c, g, or t
  modified_base (481)..(481): a, c, t, g, unknown or other
  misc_feature (481)..(481): n is a, c, g, or t
  modified_base (488)..(488): a, c, t, g, unknown or other
  misc_feature (488)..(488): n is a, c, g, or t
  modified_base (500)..(500): a, c, t, g, unknown or other
  misc_feature (500)..(500): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatcctccactgggtncgacacggcccctggacaagggcttgagtggatggggatggatcccgaaaccctaacaagtggtaggacacaactatgacacagaagtttcgagggtcagggtacacgatgaccgaggacacgtccatcagcacagcctacagtgganctgagcagctagacatcgagacgacacggactattactactgngcgagtntcggtttacggngtcgtttcgg

SEQ ID NO: 349149 - DNA, 595 bp, Homo sapiens
  misc_feature: GZ8MTXP02H870W.45.37.D04.1.454.CMB.2.raw
  modified_base (227)..(227): a, c, t, g, unknown or other
  misc_feature (227)..(227): n is a, c, g, or t
  modified_base (323)..(323): a, c, t, g, unknown or other
  misc_feature (323)..(323): n is a, c, g, or t
  modified_base (436)..(436): a, c, t, g, unknown or other
  misc_feature (436)..(436): n is a, c, g, or t
  modified_base (450)..(450): a, c, t, g, unknown or other
  misc_feature (450)..(450): n is a, c, g, or t
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
tcagacgcgatcgacacgaccggtgctcgatttagtagcatactgttgggtttggggagcatcacccagcaaccacatctgtcctctagagaatccccctgagagctccgttcctcaccatggactggacctggaggatcctcttcttggtggcagcagccacaagagcccactccccaggtgcagctggtgcagtctggggctgaggtgaggaagccgtgggcctnagtgaggtctcctgcaaggctctggctacacccttcaccggcgactactctccacgtgggtgcgacgaggcccctggaacagggcttgagtggagngggatggatcaaccccctaacaagtggtaggacaacaaaactatacgacaacgagtaagttcgagggtcacgggtacacgagtacgaacgaggacacgtccaatcgagcaacncgaccctagtacgnggganaccgngaagcagacgtagacatcgacgaaccgtacgaaccggtaccttaaacttttacgttaaccgttggttagaaccggggtaaggtaggtttacggttttaaccgggttcggtcggtttttacggtttttaccccggg

SEQ ID NO: 349150 - DNA, 542 bp, Homo sapiens
  misc_feature: GZ8MTXP02I5RLD.45.37.D04.1.454.CMB.2.raw
  modified_base (258)..(258): a, c, t, g, unknown or other
  misc_feature (258)..(258): n is a, c, g, or t
  modified_base (341)..(341): a, c, t, g, unknown or other
  misc_feature (341)..(341): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacnccttcaccggcgactatcctccactgggtgcgacaggccccctggacaagggctgagtggatgggatggatcaaccccctaanaatgggtagcaacaaactatgacaacagtaagtttcgaagggcagggtcaccatgacgagggacacgtcactcagcacacgcctaacagtaggagcctagagacgagactgacatcctagaccgacgacggacctaattttactaacgtgtacgaacgtaggtacttacggttaccggtacggtacgttcggtttttaccg

SEQ ID NO: 349151 - DNA, 600 bp, Homo sapiens
  misc_feature: GZ8MTXP02GMNKS.45.37.D04.1.454.CMB.2.raw
  modified_base (464)..(464): a, c, t, g, unknown or other
  misc_feature (464)..(464): n is a, c, g, or t
  modified_base (473)..(473): a, c, t, g, unknown or other
  misc_feature (473)..(473): n is a, c, g, or t
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagcccactccccaggtgcagctggtgcagtctggggctgaggtgaggaagccgtgggggcctcagtgaaggtctcctgcaaggcttctggctacacccttcaccggcgactatcctccacgtgggtgcgacacggccccctggacgaaggggcttgaggtggagtggggataggataccaaaccctaacaagtggtggacaacgaaactatgacaacgagtaagttccgaggggcaacgggtaccaaccgagtacggaaccgaggggaccacggtcccaatcacgacacacgcctaanagtagggancgtagacgcagtacagacattcgacgaaccgacgaaccggtacttaagtttaactacgttacggtcgtaacggtaaggttacgttacggtttaccgggtgtcgtttacgggttttaccgttttacgg

SEQ ID NO: 349152 - DNA, 597 bp, Homo sapiens
  misc_feature: GZ8MTXP02IOGZ1.45.37.D04.1.454.CMB.2.raw
  modified_base (369)..(369): a, c, t, g, unknown or other
  misc_feature (369)..(369): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctccgtgcaaggcttctggctacaccttcaccggcgactatctccacgtgggtcgcgacgacggcccctggacaagggcttggagtggagtgggatggatacaacccctaacaagtggtacgacaactaaactntacgacaacgagtaagttcgagggtcgagggtacaccgagtcgaacgagggacacgtaccatcacgcaacacgaccctaacagtacgggacgtacgagacggacaacgactacggaacctataccgtacggaaccgaaccgaccggtacccttaattttacttaacgtcgtagaaccggtaggtactttacgggtttaccggtcggttccgtttcggtttttacccgg

SEQ ID NO: 349153 - DNA, 507 bp, Homo sapiens
  misc_feature: GZ8MTXP02H2IJM.45.37.D04.1.454.CMB.2.raw
  modified_base (358)..(358): a, c, t, g, unknown or other
  misc_feature (358)..(358): n is a, c, g, or t
  modified_base (430)..(430): a, c, t, g, unknown or other
  misc_feature (430)..(430): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctgggggcctcagtgaaggtctcctgcaaggcttctggctacaccttcaccggcgactatctccactgggtgcgacaggcccctggacaagggcttgagtggatggggatggatcaaccccctaacatggtggcacaaactntgcacagaagtttcagggcagggtcaccatgaccagggacacgtccatcagcacagcctacatggagctgancagactgacatctgacacacggaccatttacttactgtgcgaggtatcggtttaccggtgggttcgttccttttagg

SEQ ID NO: 349154 - DNA, 637 bp, Homo sapiens
  misc_feature: GZ8MTXP02JF4V9.45.37.D04.1.454.CMB.2.raw
  modified_base (362)..(362): a, c, t, g, unknown or other
  misc_feature (362)..(362): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactactctccacgtgggtgcgacgacggcccctggacaagggcttgagtggatgggatggatcaacccctaacagtggtaggcaacaaactntcgcaacagtaagtttcgagggacagggtaccacgagtacgaccgaagggaccacgtccaacgcagcaacgacgtacctaacgagtacggagtcgaggacgaccgaaggacttaggaactacgtacgttaacggacccggtaaacgacccggtaacctttaaagtttttaccgttaaccggttggttacggtaaccgggtacggggtttaacgttttacggggttttaacccggggtttacggtttaccggttttcgggtttttttaaccccggg

SEQ ID NO: 349155 - DNA, 743 bp, Homo sapiens
  misc_feature: GZ8MTXP02GWBK6.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgaccagtctccagactcctggctgtgtctcgtgggcgaggacggccacatcaactgcaagtccagccagacgttgtttagacagctacaaacaataacgaactactagtctaggaccagcaagaaccaggtcacgcctactaagctgctctagtttacgtcggactactaccgtaacccgggtaacgtcccggggtaccccctacggtacccgtacgtttacgaacggttcggacgacgggtccggggtacgtacgggggtaactaacggttactttaccaacccgttccctaacctaaacccgtattacccgaagtacccgtaaacgccccgttagaccggaaaccgggtacgtaaacggaaaagtcgttgggttaggtaccgttaaggtttttaagtcggtaaccttggtacctaaggtaacttaaaatttacgtttaaattaacgtttaacctttcccggttaacccgttaccggttttacccgggaccccgtttaagggaaaaccccgtaaaggtttaacggaaacttaacgttaaaaccgaaaacccggtaaacgtttcgggaaacgggtaccttaccgg

SEQ ID NO: 349156 - DNA, 572 bp, Homo sapiens
  misc_feature: GZ8MTXP02GVCM6.45.37.D04.1.454.CMB.2.raw
  modified_base (361)..(361): a, c, t, g, unknown or other
  misc_feature (361)..(361): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacacccttcaccggcgactatcctccactgggtgcgacacggccccctggacaagggcttgagtggatgggatggatcaacccctaacatggtgacaacaaactntgacaacaagtaagtttcgaggggcgaggggtcaacccgagtacggaaccgaggggacaccgtacactacacgcaacacggaccctaacgagtgggaacgccgtagacgaccaaggactaggaacattacgacgaccgacaccggacctaatttactacgtgtgaacgtaggtacgttacggtttacggtcggtcgtttacggtttttccg

SEQ ID NO: 349157 - DNA, 510 bp, Homo sapiens
  misc_feature: GZ8MTXP02FOCUQ.45.37.D04.1.454.CMB.2.raw
  modified_base (359)..(359): a, c, t, g, unknown or other
  misc_feature (359)..(359): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctgaggtgaggaagcctgggggcctcagtgaaggtctcctgcaaggcttctggctacaccttcaccggcgactatctccactgggtgcgacaggcccctggacaagggcttgagtggatgggatggatcaaccccctaacaatggtggcacaaactntgcacagaagtttcagggtcaggggtcaccatgaccagggacacgtccatcagcacagcctacatggagctgagcagactgacatctcgacgacacggcctatttacttactgtgcgaggtacttggttaccggtggcgttggttttaccg

SEQ ID NO: 349158 - DNA, 648 bp, Homo sapiens
  misc_feature: GZ8MTXP02JJPWK.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctgaggtgaggagccgtgggcctgagtgaggtctctgcaggcttctggctacacctcgaccggcgactatcctccacgtggtgcgacgacggcccctggacgagggtctaggaggtggagtgggatggaactaccaaacccctataacgtgggtacgaccaaacgaaactgtacgacaaacgtaagtaacgtttacggacgggtacgacgggtaccaaccgacgtacgaacccgagggacctacgtaccaagtccgaacgaccaaacgtacgtacccgtaacagtacgggacgtaccgagacggacaacgggtactacggaactactacggtacggaaaccgaccgtaaccgggtaccttaatttacgttaaccgtaggtacggtaacggtaaggttacgtttaccgggttaccgggtggttaccggtttcggtttttacccggg

SEQ ID NO: 349159 - DNA, 736 bp, Homo sapiens
  misc_feature: GZ8MTXP02INIDG.45.37.D04.1.454.CMB.2.raw
  modified_base (253)..(253): a, c, t, g, unknown or other
  misc_feature (253)..(253): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctcctgcaggcttcnggctacaccttcaccggcgactactctccacgtgggtgccggacgacggcccccgtggaaccgaaggggtcttggaggtggagtggggatggactaccgaaacccctaactaagtcgggtacggacaaacgtaaactagtcgacaaacgtaagtaaaggtttaccgaagggggtaccgtaacgggggtacccaaacccgtaacgtaccgggaaacccgaaacgggggaacccgtaacccggttaacccaaacgttaccgaacggtaacccaaaccgaaaccggtaccccttaaacgaacgttacgggaacggaccctagggaacgaacgaacggacgtaggaacctagtacccgtacggaaaccgaccgaaccgggtaacccttaaagtttttaacgttacgttacggttacggaaccggtaaaggttacgtttacggggtttacccgggtttcgggttaccggttttcggtttttaacccgg

SEQ ID NO: 349160 - DNA, 599 bp, Homo sapiens
  misc_feature: GZ8MTXP02IKGWR.45.37.D04.1.454.CMB.2.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtgggctgaggtgaggagccgtgggcctnagtgagtctctgcagctngctacnctcacgnatatctccagtggtgcgacacggccctggacgaggcttgagtggagtgggatgactacaacctaacagtggtcgacaacaaactagtgacaacgagtaaacgtttcgagggcgaacggggtaccaacgagtacgaaccgagggtaaacacgtaccagtacaacgaccacgaacgtccctaagacgtggaacgcgtacgacgacgaagacgtacgaacacgtacgacgaaccgacgaaccggtaccttaaagtttaacgtttaccgtaggttcgtaacgggtaaggttacgtttacgggttttaccgggtacggtttccggtttaccggtttttacgttttacggg

SEQ ID NO: 349161 - DNA, 641 bp, Homo sapiens
  misc_feature: GZ8MTXP02I6B3N.45.37.D04.1.454.CMB.2.raw
  modified_base (345)..(345): a, c, t, g, unknown or other
  misc_feature (345)..(345): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcgagtgaggtctcctgcaaggcttctggctacaccttcaccggcgactatcctccacgtgggtgcgacgacggcccctggacgagggtctgagtggagtgggatggataccaacccctaanagtggtggacaactaaactgtcgacaacgagtaacgtttcgaaggggtcgaacgggtcaaccgagtacggaaccgacggggacaccgtaccataccgagaccaacgacggtaccctaacgtagtacgggacgtaccgtaggacgacgaaacggacgttagaaccgtattcccgtaacggaacccggaaaccgcccggtaaaccttaacgtttttaccgttaacgttaggtaccggtaacggtaggttacgtttacgggtttaccgggttcggtttcggtttacggttttttcccgg

SEQ ID NO: 349162 - DNA, 588 bp, Homo sapiens
  misc_feature: GZ8MTXP02JWA0D.45.37.D04.1.454.CMB.2.raw
  modified_base (253)..(253): a, c, t, g, unknown or other
  misc_feature (253)..(253): n is a, c, g, or t
  modified_base (359)..(359): a, c, t, g, unknown or other
  misc_feature (359)..(359): n is a, c, g, or t
  modified_base (469)..(469): a, c, t, g, unknown or other
  misc_feature (469)..(469): n is a, c, g, or t
  modified_base (546)..(546): a, c, t, g, unknown or other
  misc_feature (546)..(546): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcaggcttcnggctacaccttcgaccggcgactatcctccgacgtgggtgcgacgacggcccctaggaccgaagggtcttggaggtggagtgggatggactaccaaaccccctaanaagtggtacggacaacgaaactgtcgacaacgtaagtaacgtttcgaggggtcgagggtaccaaccgagtacggaccgaagggaccaccggtacactcgacgcaaaccgngaccctacgagtcggacgtcgagacgacagacctgactacgtcgtacgaccgacgacgtacttaattacgtacgtgngtcggagttacgttcggttacggcggttcgttcggttttacg

SEQ ID NO: 349163 - DNA, 567 bp, Homo sapiens
  misc_feature: GZ8MTXP02HA633.45.37.D04.1.454.CMB.2.raw
  modified_base (371)..(371): a, c, t, g, unknown or other
  misc_feature (371)..(371): n is a, c, g, or t
  modified_base (437)..(437): a, c, t, g, unknown or other
  misc_feature (437)..(437): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatcctccacgtgggtgcgacacggcccctggacaagggctttggagtggagtggggatgggatcccgaaaccctaacaagtggtggcaacaactntgacacagtaagtttcagggcagggtcacgatcgaccgaggacacgtccatcgagcacagacctanacgtaggacgcgtagagcgaagacgtagaactagttcgacggaccgacgaccggtaccttaagttttaactacgttaggtcggacgtaaggtacgtttacggtttaccgggtcggttaccggttttcggg

SEQ ID NO: 349164 - DNA, 536 bp, Homo sapiens
  misc_feature: GZ8MTXP02HU7CT.45.37.D04.1.454.CMB.2.raw
  modified_base (345)..(345): a, c, t, g, unknown or other
  misc_feature (345)..(345): n is a, c, g, or t
  modified_base (364)..(364): a, c, t, g, unknown or other
  misc_feature (364)..(364): n is a, c, g, or t
  modified_base (430)..(430): a, c, t, g, unknown or other
  misc_feature (430)..(430): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctggggcctcagtgaggtctcctgcaaggcttctggctacaccttcaccggcgactatcctccactgggtgcgacacggcccctggacaagggcttggagtggagtgggatggatcaaaccccctaanagtggtagacaacaaactntgacacagtaagttcgagggcagggtcaccgatcgaccgagggacacgtcatcagcacagacctanacgtggagcgtagagacagactgaccatctagacgacacggacttaatttacgtacgtgagtaacgaggtacgttacggttacggtcgtcgtttcggttttacccg

SEQ ID NO: 349165 - DNA, 673 bp, Homo sapiens
  misc_feature: GZ8MTXP02JTX54.45.37.D04.1.454.CMB.2.raw
  modified_base (282)..(282): a, c, t, g, unknown or other
  misc_feature (282)..(282): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctgagtgaggtctcctgcaaggtcttcgtggctacaccttcgaccggcgactactcnccacgtgggtgcgacgtcggccccgtaggacgaagggtcttaggaggtggagtgggagtggactacgaacccctacgaagtgggtacggaccaacgtaaactgtacgacaacgtaagtaagtttacggacggggtcaacggggtacaaccgagtacggaaccgaaggggacctacccggtaccaactaccgacgacctaaacgaccgtaacccgtacgtaagtacggggacgtacgtacgggacgacggtaacgaacgtcggaaactacgtacgtacggaacccgaacggaacccggtcttaaacgttttaacgttaccgtggttacggaacggtaaggttacggtttacgggtttaccgggtcggtttacgtttcgggtttttaacccgg

SEQ ID NO: 349166 - DNA, 584 bp, Homo sapiens
  misc_feature: GZ8MTXP02HHLB3.45.37.D04.1.454.CMB.2.raw
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagcccactccccaggtgcagctggtgcagtctgggggctgaggtgaggaagcctgggggcctcagtgaaggtctcctgcaaggcttctggctacaccttcaccggcgactatctccactgggtgcgacaggccccctggacaagggcttggagtggatggggatggatacgaaaccctaaccaagtggtaggacaacaaaactatgacaacaacgtaagtttcgaggggcgagggtacaccgagtacgaccgaggggaccacgtccatcgagcacagacctacagtaggacgcgtagagctagactgactatacgagaaccgacgaccgggtacctaatttacgttaaccgtggtacggacgtaagggtacttacgggtttaccgggtggtccgtttcgggttttaccgttttacggg

SEQ ID NO: 349167 - DNA, 561 bp, Homo sapiens
  misc_feature: GZ8MTXP02GOJP7.45.37.D04.1.454.CMB.2.raw
  modified_base (353)..(353): a, c, t, g, unknown or other
  misc_feature (353)..(353): n is a, c, g, or t
  modified_base (438)..(438): a, c, t, g, unknown or other
  misc_feature (438)..(438): n is a, c, g, or t
  modified_base (442)..(442): a, c, t, g, unknown or other
  misc_feature (442)..(442): n is a, c, g, or t
  modified_base (454)..(454): a, c, t, g, unknown or other
  misc_feature (454)..(454): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatcctccacgtgggtgcgacgacggccccgtggacgaagggtcttggaggtggagtgggatggactaccaaacccctaanagtggtacggacaacaaactgtagacaacgagtaagtttcgaggggacgagggtcaaccgagtacgaccgagggacaccgtacancgancacacgacctanagtgacgctagagcagactagacatcgacgacgacacggtactatttacgtacgtggtacgaacgtaggtacgtttacggttacggtcggtcgtttcggttttaccg

SEQ ID NO: 349168 - DNA, 525 bp, Homo sapiens
  misc_feature: GZ8MTXP02HLSQ3.45.37.D04.1.454.CMB.2.raw
  modified_base (351)..(351): a, c, t, g, unknown or other
  misc_feature (351)..(351): n is a, c, g, or t
  modified_base (406)..(406): a, c, t, g, unknown or other
  misc_feature (406)..(406): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggctcagtgaggtctctgcaaggctctggctacaccttcaccggcgactatctccactgggtgcgacaggcccctggacaagggcttgagtggatgggatggatcaaccccctaacaatggtgcaacaaactntgcacagtaagttcgagggcaggggtcacgatagacgaggacacgtcatcagcanacgcctacgatggagctagagacgagactagactatcgtacgacgacgacggacctatttacttacgtagttgaacggtagtacgttcggttaccggtcggtcgtttcggtttttccgg

SEQ ID NO: 349169 - DNA, 578 bp, Homo sapiens
  misc_feature: GZ8MTXP02H4Y9Y.45.37.D04.1.454.CMB.2.raw
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (357)..(357): a, c, t, g, unknown or other
  misc_feature (357)..(357): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctgaggtgaggagcgtgggctgagtgagtctctgnagctnggctacaccttcaccggcgactatctccacgtggtgcgacgcggccccgtggaacgaggtctggagtggagtgggatggactacaaacccccaagaagttggagacaacgaaatnagacaacgagtaagttcgagggcgaggtccacagcgacgacgggacacgtcagacagacaacgagaccctagaagtagggagtaccgtaggaacgacgagacagacaatccgtacggaaccgacgaaccggtaccttaaagttttaacttaccgtggtacggtaacggtagtaacgtttcggtttaccgggtacggttccggtttacggttttttacccgg

SEQ ID NO: 349170 - DNA, 631 bp, Homo sapiens
  misc_feature: GZ8MTXP02J0I64.45.37.D04.1.454.CMB.2.raw
  modified_base (250)..(250): a, c, t, g, unknown or other
  misc_feature (250)..(250): n is a, c, g, or t
  modified_base (349)..(349): a, c, t, g, unknown or other
  misc_feature (349)..(349): n is a, c, g, or t
  modified_base (370)..(370): a, c, t, g, unknown or other
  misc_feature (370)..(370): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtgggcctcagtgaggtctcctgcaggcttcgnggctacaccttcaccggcgactatcctccacgtgggtgcgacgacggccccgtggacaagggcttggaggtggagtgggatggactaccaacccctaanagtgggtacgacaacaaactntcgacactagtaacgttcgaggggcgacgggtacaccgagtcgaccgagggacaccgtacatacgacgacacgacgacctacgagtagggacgtacgtaggaacgtaccgaacggtactacggaacctagttacccggtacggaaaccgaaccgaaccgggttaccttaaagttttaacgttaccgttaggtacggtcgggtaaaggttacgtttacggggttttacccgggtcggtttaccggtttcggtttttacccgg

SEQ ID NO: 349171 - DNA, 629 bp, Homo sapiens
  misc_feature: GZ8MTXP02G2DY2.45.37.D04.1.454.CMB.2.raw
  modified_base (253)..(253): a, c, t, g, unknown or other
  misc_feature (253)..(253): n is a, c, g, or t
  modified_base (347)..(347): a, c, t, g, unknown or other
  misc_feature (347)..(347): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggagccgtgggctcagtgaggtctctgcagcttctggctacnccttcgaccggcgactatcctccacgtggtcgcgacgacggcccctaggacgaagggtcttggagtggagtgggatggactacaaccccctaanagtcggtggacaacaaactgtcgacacgaagtaacgtttcgagggcgacggggtcaaccgagtacgaccggagggaccaccgtccgaagtcgacgaccaacacggtaccctacgtagtcggacgtacgtagacgacgtaacgacttacgaacgtacgtaccgtacgaaccggaaccgtaccggtaccttaaacgttttacgttacgttacggtacggtaacggtaacggttacgtttacgggtttaccgggttacggtttccggtttacggtttttacccgg

SEQ ID NO: 349172 - DNA, 638 bp, Homo sapiens
  misc_feature: GZ8MTXP02GOEC2.45.37.D04.1.454.CMB.2.raw
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcaaggcttctggctacaccttcaccggcgactatcctccacgtggtgcgacgacggccctggacgaagggtcttggaggtggagtgggagtaggactacccaaaccctaaacgaaagtggtacggaactaactaaaccgtatacgacaacgaaggtaacgtttacgaagggtacgacgggtaccaaccgagtacgaaccgaacggaccgtacgtacccaactcgaacgacaaccgaacggtaccttaacgagtagggacgtacgtagaacgacgaacgacgtacgaactacgttacgacgaacgaaccgtacggtaccctttaatttaacgttacgtcggtaacgacggtaaggtacgtttacggtttaccggttggtcgtttttaccggg

SEQ ID NO: 349173 - DNA, 571 bp, Homo sapiens
  misc_feature: GZ8MTXP02HA0CC.45.37.D04.1.454.CMB.2.raw
  modified_base (327)..(327): a, c, t, g, unknown or other
  misc_feature (327)..(327): n is a, c, g, or t
  modified_base (382)..(382): a, c, t, g, unknown or other
  misc_feature (382)..(382): n is a, c, g, or t
  modified_base (445)..(445): a, c, t, g, unknown or other
  misc_feature (445)..(445): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggcccaccatcaactgacaagtccagccagagttgtttagacagctaccaaacaataagaactacttagcttggtaaccagacaagaaaccaggtacacgcctacctaagctgctctatttacgnggacactaccgtaccgggacgtcccggggtcccctagaccgtattcgaggtgcgnggcgggtgtggggacagtattcgactctacaccatcgagcacgcctagcagggctagaaagtntaggtcgtattagtttagtgaccgtgtacagacttaaattatttattacttacttcccgtactaccgtttccggaccgttaggaacctaaagttcgaatacaacgaacgtacgtggtacactaccg

SEQ ID NO: 349174 - DNA, 677 bp, Homo sapiens
  misc_feature: GZ8MTXP02H14S7.45.37.D04.1.454.CMB.2.raw
tcagacgcgatcgacacgaccggtgctcgatttagtagcatactgttgggtttgggggagagcatcacccagcaaccacatctgtcctctagagaatcccctgagagctccgttcctcaccatggactggacctggagatcctcttctggtggcagcagccacaagacgcccactcccaggtgcagctggtgcagtcgtggggctgaggtgaggaagccgtggggcctgagtgaggtctccgtgcaaggtctcgttggctacaccttcgaccggcactactcctccgacgtgggtcgccgtacgaccggtcccccgtagggaaccgtaaacggggtctttaggaggttgggacgtggggtataggtaactaccccgaaaacccctaaacgaagtgggtacgaccaaactaacgtatacgaccaacgtaagtaacggtttacgaggggtcgagggtaccaacgtataccggaacgaggggaaccacgtaccaagtcgaacgacacgaccgacctaacgagtcgggacgacgtcggaagcgaagaccgttacgaactacgttaccgacgtaaacccgaaccgtaccgggtaacctttaagtttaacgtttaccgtagggtaacgtacggttaaggttacggtttacggtttacccgggttggtttaccgtttttccggg

SEQ ID NO: 349175 - DNA, 552 bp, Homo sapiens
  misc_feature: GZ8MTXP02HTAG6.45.37.D04.1.454.CMB.2.raw
  modified_base (486)..(486): a, c, t, g, unknown or other
  misc_feature (486)..(486): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctggggcctcagtgaaggtctcctgcaaggcttctggctacaccttcacccggcgactatcctccactgggtgcgacacggccccctggacgaagggcttggagtggatgggatggatcaaccccctaacgaatggtaggcaacgaaactatgacaaccagtaaagtttcgaaggggtacgaggggttcaacccgagtacgacccgaggggacaaccggtccatccagcacagcctacagtggagcctagagacagactagacagtacncgacggacaccggcctattattactgtgcgagtacgttacgttacggtcggtcgttcggttttccg

SEQ ID NO: 349176 - DNA, 526 bp, Homo sapiens
  misc_feature: GZ8MTXP02JUFT8.45.37.D04.1.454.CMB.2.raw
  modified_base (311)..(311): a, c, t, g, unknown or other
  misc_feature (311)..(311): n is a, c, g, or t
  modified_base (358)..(358): a, c, t, g, unknown or other
  misc_feature (358)..(358): n is a, c, g, or t
  modified_base (395)..(395): a, c, t, g, unknown or other
  misc_feature (395)..(395): n is a, c, g, or t
  modified_base (415)..(415): a, c, t, g, unknown or other
  misc_feature (415)..(415): n is a, c, g, or t
  modified_base (430)..(430): a, c, t, g, unknown or other
  misc_feature (430)..(430): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactactagcttggtaccagcagaaaccaggtcagcctctaagctgctcatttacnggcatcgtacccgggaatccggggtcccctgaccgattcagtcggcnggcgggtctgggacagtatttcaactctcaccatcancacgcctagcagctgaaagntgtggctagttttangctgtcagtcaaattatttatacttacttccctccgtacgtttcggaccctgggaaaccctaagtgaattacacaaaaccgagtcgtacggctacg

SEQ ID NO: 349177 - DNA, 550 bp, Homo sapiens
  misc_feature: GZ8MTXP02J0LF8.45.37.D04.1.454.CMB.2.raw
  modified_base (453)..(453): a, c, t, g, unknown or other
  misc_feature (453)..(453): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatcctccacgtgggtgcgacgacggccccgtggacagggcttgagtggagtgggatggactaccaaaccccctaacaagtggtacggcaacgaaactgtcgacaacgagtaagtttcgaaggggcctaggggtaccacgagtcgaccgagggacacgtaccatccagcacgacgacctanacgtggagctgagcgagactgacatcgtacacgacacggactatttactactgtcgcgaggtacgttcggttacggtcggttcgttcggttttaccg

SEQ ID NO: 349178 - DNA, 695 bp, Homo sapiens
  misc_feature: GZ8MTXP02GUEGS.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgacaagtccagccagtagttgtttagacagcctaccaaacaataagaactacttagcttggtaccagcaagaaaccaggtcagcctcaagctgctactatttacgtggactacgtccgtaacccggggacgttcccggggtccccctacgacccgtattccgaaggttcggacacggggtccgggtcgtacggggacaggtactttccgaccttcctaccaaccctataccgacgtccaacgtcccgtagaccggacggacgttaggaaaagtgtttagggtacggtacgttaaggtttttacgttacgtcgttacggttaccaaggtaactaaatttaatttaatttaactttaacctttcccgttaccgttaacccgttttcccgggaccccgttagggggtaaaacccctaaaggttacgggtaaacttaacgtaaaccgtaaaaccggtaaccgttggtaccggtacttaaccgg

SEQ ID NO: 349179 - DNA, 522 bp, Homo sapiens
  misc_feature: GZ8MTXP02F5X1G.45.37.D04.1.454.CMB.2.raw
  modified_base (360)..(360): a, c, t, g, unknown or other
  misc_feature (360)..(360): n is a, c, g, or t
  modified_base (435)..(435): a, c, t, g, unknown or other
  misc_feature (435)..(435): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatctccactgggtgcgacaggcccctggacaagggcttgagtggatgggatggatcaaccccctaacaagtggtggcaacaaactngcacagaagtttcgagggcagggtcaccatacgaccgaggggacacgtccatcagcacagcctacagtggagtcngagcaggactgacatccagacgacaccggactatttactacgtgtagcgaggtacttcggtttaccggtggtcgttcgttttaccgg

SEQ ID NO: 349180 - DNA, 525 bp, Homo sapiens
  misc_feature: GZ8MTXP02FQMCO.45.37.D04.1.454.CMB.2.raw
  modified_base (359)..(359): a, c, t, g, unknown or other
  misc_feature (359)..(359): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagacgtggggcctcagtgaaggtctcctgcaaggcttctggctacaccttcaccggcgactatctccactgggtgcgacaggcccctggacaagggcttgagtggagtgggatggatcaaccccctaacaatggtggcaacaaactntgacacagtaagtttcgaggggacaggggtcaccatcgacgagggacacgtccatcagcactacgcctacatggagactgagcagactgaacatcagacgacgacggacctatttactacgtgtagcgaggtacgttcggtttaccggtggtcgttggttttaccg

SEQ ID NO: 349181 - DNA, 561 bp, Homo sapiens
  misc_feature: GZ8MTXP02IO1ME.45.37.D04.1.454.CMB.2.raw
  modified_base (368)..(368): a, c, t, g, unknown or other
  misc_feature (368)..(368): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtcgtggggctgaggtgaggaagccgtggggcctcagtgaaggtctcctgcaaggcttctggctacaccttcaccggcgactatcctccactggtcgcgacacggcccctggaccaagggtcttggagtggagtgggatggataccaacccctaacaagtggtgcaacgaactntgcacgagtagtttcgagggtcagggtcaccgagtacgacgagggacaccgtcatcagcaacgacgcctacgagtcggagcctgacgacgacgatacgacagtcgtacgacgaccacggtacctaattttactaccgtgtcgaacggtaggtacgttacggtttaccggtcggttaccgtttggtttttaccg

SEQ ID NO: 349182 - DNA, 606 bp, Homo sapiens
  misc_feature: GZ8MTXP02F8599.45.37.D04.1.454.CMB.2.raw
  modified_base (312)..(312): a, c, t, g, unknown or other
  misc_feature (312)..(312): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttagacagctccaacaataagaactactagcttggtaccagcagaaaccaggtcagcctactaagctgctcatttacnggctacgtccgtaccgggaacgtccggggtcccccctacgaccgtattcgaggtcggcgaggtcgggtcgtggggacagtactttcactccgtccaaccatacgagccacgccctggccagggctaggaaaagtcgtggtcgggtacttagttttagtcggaccttggtacagtactaaattatttattaactttactttcccgtaccgttacgtttccggaccgtacggggtaaaacccaaaggttcggaaattaacctaacgtaaaaccggtacgtggtacgggcttaacgg

SEQ ID NO: 349183 - DNA, 646 bp, Homo sapiens
  misc_feature: GZ8MTXP02JRZ18.45.37.D04.1.454.CMB.2.raw
  modified_base (252)..(252): a, c, t, g, unknown or other
  misc_feature (252)..(252): n is a, c, g, or t
  modified_base (294)..(294): a, c, t, g, unknown or other
  misc_feature (294)..(294): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaggcttcnggctacaccttcgaccggcgactatctccacgtggtgcgacncggcccctggacgagggtcttggaggtggagtgggatggatacaaccccctaagaagtggtacggacaacgaaactagtcgactacgagtaacgtttcgagggcgagggtaccacgatcgaccgagggaccaccggtacacgtcgacgcacgacgaccctacgagtcgggacgtacgtacggaacgacaacggtacgtacggtaacctacgtccgtaaccggaaccggaaccggtaacccgggtacccttaaagttttaacgttaacccgttggtacgggtaacggtacgggttacgtttaccggggtttaacccggggtcggtttccggtttacgggttttttaacccggg

SEQ ID NO: 349184 - DNA, 687 bp, Homo sapiens
  misc_feature: GZ8MTXP02FNYTR.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttagacagctaccaacaataagaactactagcttaggtacccagacaagaaaccaggtcagcctacctaagctgctctatttacgtgggctactaccgtaaccccggggaaacgtcccggggtaccccctacggacccgtaattccgaggtcggcacgggccggggtcgtaggggaccaggtactttccgacttccctacaaccctataccgagccgacgccctggaccaagggagttaggaaaagtgttaggtacgggtacttaaggtttttaacgttgccgttagttacgaagtactaaaatttaattttaaagtttaactttaaccgtttccccgttacccgtttaaccgttttcccgggtaccccgttaacgggggaaacccttaaaaggttaccggaaattaacgtaaaccgtaaaacggtaaccgtaggttacgggaccttaaccgg

SEQ ID NO: 349185 - DNA, 606 bp, Homo sapiens
  misc_feature: GZ8MTXP02JRMDM.45.37.D04.1.454.CMB.2.raw
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctctgcaaggcttctggctacaccttcaccggcgactatcctccactgggtgcgacacggccccctggacaagggcttgagtggatggatggatcaacccctaacaatggtgcanaaactntgacanagattcgagggcaggtcacatagacagggacacgtaccaagtcagcacgacgacctacgattggacgtaccgtagacgacaacggtactacggaacacttaccgtacggaaacccgaaacgaacccggggtacccttaaagttttaaccttaaaccgttcggttagaacccgggtaaagggtaacgtttaccggggttttaaccccggggtggttaacccggttttcgggttttttaaccccgg

SEQ ID NO: 349186 - DNA, 564 bp, Homo sapiens
  misc_feature: GZ8MTXP02HTDTU.45.37.D04.1.454.CMB.2.raw
tcagacgcgatcgacacgaccggtgctcgattttagtagcatactgttgggtttgggggcatcaccccagcaaccacatctgtcctctagagaatccccctgagagctccgttcctcaccatggactggacctggaggatcctcttcttggtggcagcagccacaagagccccactccccaggtgcagctggtgcagtctggggctgaggtgaggaagctggggcctcagtgaaggtctcctgcaaggctctggctacacttcaccggcgactatctccactgggtgcgacacgggcccctggacaagggctgagtggatggggatggatcaaccctaacagtggtgacacaaactatcgacaacagagtttcagggacacggggtcaccatgaccaggggacacgtccgatcagacacagcctacatcgagctagagacagacctgacatcgtacgacgacgacggacctaagttttaacttacgttggttcgacggtaaggtaacgtttcgggttttaacccgggttgggtcctttacggggttttccctttttaaccgggg

SEQ ID NO: 349187 - DNA, 656 bp, Homo sapiens
  misc_feature: GZ8MTXP02H7K2D.45.37.D04.1.454.CMB.2.raw
  modified_base (358)..(358): a, c, t, g, unknown or other
  misc_feature (358)..(358): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctgggctgaggtgaggaagccgtggggcctcgaggtgaaggtctcctgcaaggcttctggctacaccttcgaccggcgactactcctccacgtgggtgcgacgacggcccttaggaacgaagggtcttggagtggagtgggagtggactaccaaacccctaaanagtggtacgacaacgaaactgtacgactacgaagtaagtttcgacgggtcgagggtaccaccgagtacgaaccgaggacctacgtaccataccacgaccaacgacgtaccctacgtagtacgggactcgacgaacgcaagtacgtagaacgtacgttaccggtacggtaaaccgaaccgtaaccgggtacctttaaacgttttacgttaacgttacggtacgggaaccggttaagggttaacgtttaccggggttttaaccgggtccgggtttcgtttaaccgggttttttaccccgg

SEQ ID NO: 349188 - DNA, 572 bp, Homo sapiens
  misc_feature: GZ8MTXP02HFFES.45.37.D04.1.454.CMB.2.raw
  modified_base (250)..(250): a, c, t, g, unknown or other
  misc_feature (250)..(250): n is a, c, g, or t
  modified_base (370)..(370): a, c, t, g, unknown or other
  misc_feature (370)..(370): n is a, c, g, or t
  modified_base (538)..(538): a, c, t, g, unknown or other
  misc_feature (538)..(538): n is a, c, g, or t
  modified_base (557)..(557): a, c, t, g, unknown or other
  misc_feature (557)..(557): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctctgcaaggcttcnggctacaccttcgaccggcgactatctccacgtgggtgcgacacggcccctaggaacgaagggcttgagtggatgggatggactacaacccctaaacaagtgggagacaaacgaaaactntgacaacagtaaacgtttgaagggtcgaacgggtaccaaccaagtcggaaacccgaggggaaccaccggtacccaatcaacgcaacgacgcctaacgatgggaacgcagacgacgtagaccgtgaaccatacgacgaacgacacggtacctaatttactacgtgtcgnggagtacgttgttaccggngtcgtttcgtttccg

SEQ ID NO: 349189 - DNA, 505 bp, Homo sapiens
  misc_feature: GZ8MTXP02FPIZL.45.37.D04.1.454.CMB.2.raw
  modified_base (361)..(361): a, c, t, g, unknown or other
  misc_feature (361)..(361): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactggggtgcgacaggccccctggacaaggggcttgagtggatggggatggatcaacccccctaacaatggtggcacaaactntgcacagaagtttcagggcaggggtcacccatgaccagggacacgtccatcagcacagcctacatggagctgagcagactgacatctgacgacacggccatttactactgtgcgaggatcggtttaccggtggtctggtttccg

SEQ ID NO: 349190 - DNA, 715 bp, Homo sapiens
  misc_feature: GZ8MTXP02ISSLD.45.37.D04.1.454.CMB.2.raw
  modified_base (252)..(252): a, c, t, g, unknown or other
  misc_feature (252)..(252): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcagtgaaggtctcctgcaaggtcttcgnggctacaccttcgaccggcgactatcctccacgtgggtcgcgacgacggcccccgtaggaccgaagggtctaggagtggagtgggatggactaccaaaccccctaacgaagtggtacggacaacctaaactgtacgacaacgtaagttaacggtttacggaacggggtacgaacggggttaccaaccgtaagtacgggaacccgaacggggaaccgtaaccgttacccgaactaccgacggacccaaaccgacggtacccctaacgtaagggttacggaaccggttacgtacggaacgaccgaacggttaaccgtagaacctacgtaaccgttacggaacccgtaccggaaacccggttaccgttaaattttaaccgttacgtttaggacggtaaccggtaggttaacggttttacgggtttaaccgggtacggtttccggtttttcgggtttttaacccggg

SEQ ID NO: 349191 - DNA, 561 bp, Homo sapiens
  misc_feature: GZ8MTXP02FRQXZ.45.37.D04.1.454.CMB.2.raw
  modified_base (288)..(288): a, c, t, g, unknown or other
  misc_feature (288)..(288): n is a, c, g, or t
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccatgggtncgacaggcccctggacagggcttgagtggagtgggatggatcccaaccctaacaatggtaggacaacaactatcgacaaccgaagtaacgtttcgaggggcaggggtcaaccatacgaaccgagggacacgtccaatcagcacagcctaacngtagggaanccgtagacggacaagacctagacatactagaaccgacacggacctaagtttaactacgttaagtcggtacgtaagggtacgttacggttttaccgggcggttactttccggg

SEQ ID NO: 349192 - DNA, 643 bp, Homo sapiens
  misc_feature: GZ8MTXP02JCBE6.45.37.D04.1.454.CMB.2.raw
  modified_base (251)..(251): a, c, t, g, unknown or other
  misc_feature (251)..(251): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctcctgcaggcttcnggctacaccttcaccggcgactatcctccacgtgggtgccgacacggccccgtaggacgaagggcttggaggtggagtggggatggactaccaaaccccctaagaagtgggtaggacaacgaaactgtgacacgaagtaacgtttcgaggggcaggggtcaccgatacgaccgagggacacgtcatcacgcacgagcctacgagtggagcgtagacgacgacggtaactcggaacagttaccgtacggaccggaaaccgtacccggggtaaccctttaaagtttttaaaccgttaacggttcggttacggaaccgggttagggttaaacggttttcggggttttaaacccggggtggggtttcccgttttcggggtttttttaaccccgggg

SEQ ID NO: 349193 - DNA, 661 bp, Homo sapiens
  misc_feature: GZ8MTXP02HURX9.45.37.D04.1.454.CMB.2.raw
  modified_base (325)..(325): a, c, t, g, unknown or other
  misc_feature (325)..(325): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctctgggcgaggagggccaccatcaactgcaagtccagccagagttgtttagacagctaccaacaaataaagaactacttagcttggtaaccagcaagaaaccaggtcagccctacctaagctgctactatttacgngggcacgtaccgtaaccccggggtaagtccccggggtccccctacggacccgtattaccgagtcgggctaggggtccggggtcgtacgggggacctaaggtacttttccacttcctacccaaccctataccaggccaacggtccctagccgtagggactaggaaagtagttggtaggtacgttaaggttttacgtgtacgtcggtacaaggtactaaaattatttaatttaacttactttccccgttaccgttaaccgtttccggtaccccgttacgggaaaccctaaaggtggtaaacttacaaaccgtaaaacgacgttaggtcgtactaaccg

SEQ ID NO: 349194 - DNA, 498 bp, Homo sapiens
  misc_feature: GZ8MTXP02GBMO4.45.37.D04.1.454.CMB.2.raw
  modified_base (358)..(358): a, c, t, g, unknown or other
  misc_feature (358)..(358): n is a, c, g, or t
  modified_base (442)..(442): a, c, t, g, unknown or other
  misc_feature (442)..(442): n is a, c, g, or t
  modified_base (484)..(484): a, c, t, g, unknown or other
  misc_feature (484)..(484): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctgaggtgaggaagcctggggcctcagtgaaggtctcctgcaaggcttctggctacaccttcaccggcgactatctccactgggtgcgacaggcccctggacaagggcttgagtggatgggatggatcaaccccctaacaatggtggcacaaactntgcacagaagtttcagggcaggggtcaccatgacagggacacgtcatcagcacagcctacatggagctgagcagactgacatcngacgacacggccatttactactgtgcgaggatggttaccggnggtctggttttccg

SEQ ID NO: 349195 - DNA, 641 bp, Homo sapiens
  misc_feature: GZ8MTXP02GR6FY.45.37.D04.1.454.CMB.2.raw
  modified_base (607)..(607): a, c, t, g, unknown or other
  misc_feature (607)..(607): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtagaaggtctccgtgacgaaggtcttcgtggctacaccttcgaccggcgactactcctaccgacgtggggtcgcgacgacggcccccgtaggaacgaagggctttaggaggtggagtggggattaggaactaccaaaccctaaacgagtggtacgacaacaaacgttatcgacaacgaagtaagttacgagggacgagggtacaccgagtacgaacgaacgggaactacgacaatacgaacgacaacgaacgcctaaacgagtacggagtcgagaacgacgacggactaggaacctatacgacggaacgaccgacggttaccttaagtttaactacgtcggtaggacggtaaggttacgtttacgggtttacccggngggtttccgtttacgggtttttactttaaccggg

SEQ ID NO: 349196 - DNA, 690 bp, Homo sapiens
  misc_feature: GZ8MTXP02IUMOB.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctcagtgaaggtctcctgcaaggcttcgtggctacaccttcgaccggcgactatcctccacgtgggtgcgacgacggccccgtggaccgaagggtcttggagtggagtgggatggactaccaacccctaacgaagtgggtaggacaaacaaactgtacgacaaacgaggtaaacggtttacgaacgggggtcgaacggggttaccaacccgtaagtacggaaacccggaaggggaacctaacccggtacccgaagtaccgaaacggaccaaaccgaaccggtaccctaaacgtacgttacgggacgtaccgtacggaacgaccgaagtaaccgtacgaacgtactacggtacggaaccgaccggaaccggtaccttaaagttttacgttacgtacggtacggaacgggtaaggtacgtttacgggtttacccgggtcggttacggttttacggtttttacccggg

SEQ ID NO: 349197 - DNA, 603 bp, Homo sapiens
  misc_feature: GZ8MTXP02IJ8U0.45.37.D04.1.454.CMB.2.raw
  modified_base (368)..(368): a, c, t, g, unknown or other
  misc_feature (368)..(368): n is a, c, g, or t
  modified_base (446)..(446): a, c, t, g, unknown or other
  misc_feature (446)..(446): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaggcttctggctacaccttcaccggcgactattcctccacgtgggtgcgacgacggcccctggacaagggtcttgagtggagtgggatggataccaaaccccctaacaagtggtggacaacaactntgcaacgagtaacgtttcgagggcgacgggtcaaccagtacgacccgaaggggaccaccggtacatcgacgccaaacncgaccctacgatacgggacgtacgcggaagccgaagaccgtagaaacctagtccgtaacggacgaccgaccgggtaccttacgttttacgttacctggtagtcggtaagggttactttacgggtttaccggtcggttccgtttagggtttttacccg

SEQ ID NO: 349198 - DNA, 582 bp, Homo sapiens
  misc_feature: GZ8MTXP02HMJ8A.45.37.D04.1.454.CMB.2.raw
  modified_base (255)..(255): a, c, t, g, unknown or other
  misc_feature (255)..(255): n is a, c, g, or t
  modified_base (370)..(370): a, c, t, g, unknown or other
  misc_feature (370)..(370): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttcnggctacaccttcaccggcgactatcctccacgtgggtcgcgacacggcccctaggacaagggcttggagtggatgggatggatacccaaacctaacgagtggtggacaacaactntgacacgagtaacgtttcgagggtcagggtaccacgagtacgacgagggacacgtaccatcagaccaacacgacccttaagacgttagggagtcgagacgaccaaggtaccttaggactacgttacgacggaacgaaccacggtaccttagtttaaactcgtaggtaagacggtaggtacgttcggtttacccggtggttacgttttccggg

SEQ ID NO: 349199 - DNA, 679 bp, Homo sapiens
  misc_feature: GZ8MTXP02ICET8.45.37.D04.1.454.CMB.2.raw
  modified_base (387)..(387): a, c, t, g, unknown or other
  misc_feature (387)..(387): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcgtgggcctcagtgaaggtctcctgcaaggcttctggctacaccttcaccggcgactactctccacgtggggtgcgacgacggccccctgggaccgaagggtccttggaggtgggagtggggatgggactaccaaacccccgtaaacaagtgggtacggacaaacctaaactntcgacaacgtaacgtaagtttacgaggggacgtacggggtaccaaccgagtacggaacccggaagggaaccaccggttacaacgtaccgacgaccaacgtacggaccccttaaccgagttacgggaaacgtcccgtaggaacggacaacggtaacttacgggaactacgttaccgtacggaaacccgaaccgaaccgggtacccttaaattttacgttaaccgttggtacggtaacgggtaggtacgtttacggggtttaccgggtcggttcggtttacggtttttacccgg

SEQ ID NO: 349200 - DNA, 552 bp, Homo sapiens
  misc_feature: GZ8MTXP02HPFEG.45.37.D04.1.454.CMB.2.raw
  modified_base (368)..(368): a, c, t, g, unknown or other
  misc_feature (368)..(368): n is a, c, g, or t
  modified_base (468)..(468): a, c, t, g, unknown or other
  misc_feature (468)..(468): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggcgcagtctggggctgaggtgaggaagcctgggggcctcgagtgaaggtctcctgcaaggcttctggctacaccttcaccggcgactatctccactgggtgcgacacggcccctggacaagggcttgagtggatgggatggatacaaccccctaaacaagtggtaggacaaccaaaactntacgacaacgagtaaagtttcgaggggctagggtacaccgatcgaccagggacaccgtcagtcagcacacgcctacagtagacgcgtagacgcaagacgngacgtatcgtacgacgacgacgtacttacgtttacgtacgtgtacgcgtagtacgttacggtacggtcggtcgtttcggtttcg

SEQ ID NO: 349201 - DNA, 595 bp, Homo sapiens
  misc_feature: GZ8MTXP02JPQVR.45.37.D04.1.454.CMB.2.raw
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (501)..(501): a, c, t, g, unknown or other
  misc_feature (501)..(501): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggagtgaggagcgtgggcctnagtgaggtctcctgcaggctcgngctacncctcgaccggcgactactctccacgtgggtcgcgacgacggcccgtggaacgaagggtcttggaggtggagtggggatggactaccgaacccctaagacgtggtacggacaacgaactagtcgacaacgtaagtagttcgagggcgtaacgggtcaacccgagaccggacgaacggggacctacggtaccactacgacgcaacggactacctacgagtaggacgtcgagacgacgagactgaaccncgtacgacgacgaccgtacgtacttaacgtttacgtacgtacgtagaacggtagtacggtttacggttcggtacggttacggtttacggtttcg

SEQ ID NO: 349202 - DNA, 547 bp, Homo sapiens
  misc_feature: GZ8MTXP02JZY36.45.37.D04.1.454.CMB.2.raw
  modified_base (368)..(368): a, c, t, g, unknown or other
  misc_feature (368)..(368): n is a, c, g, or t
  modified_base (440)..(440): a, c, t, g, unknown or other
  misc_feature (440)..(440): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatcctccacgtgggtgcgacaggcccctggacagggctgagtggagtgggatggataccaaaccccctaacaagttgggtaggacaacaaactntcgacaacgagtaagtttcgaggggcaggggtccacgatgaccgagggacacgtccagtcagcacagcctanagtggagctgacgcacgactgactatctacggacgacacggtacctactttacttacgtgtgaacgtaggtagttcggtttaccggtggttccgttggttttacccg

SEQ ID NO: 349203 - DNA, 612 bp, Homo sapiens
  misc_feature: GZ8MTXP02H3BQ8.45.37.D04.1.454.CMB.2.raw
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (430)..(430): a, c, t, g, unknown or other
  misc_feature (430)..(430): n is a, c, g, or t
  modified_base (438)..(438): a, c, t, g, unknown or other
  misc_feature (438)..(438): n is a, c, g, or t
tcagacgcgatcgacacgaccggtgctcgatttagtagcatactgttggggtttggggcatcaccccagcaaccacatctgtcctctagagaatccccctgagagctccgttcctcaccatggactggacctggaggatcctcttcttggtggcagcagccacaagagcccactcccaggtgcagctggtgcagtctggggctggaggtgaggaagcgtggggcctcgagtgaaggtctcctgcaaggcttcnggctacncctcaccggcgactactctccacgtgggtgcgacacggccccctggacaagggcttggaggtggagtggggatggatccaaacctaacaagtggtacggacaacaaactagtgacacagtagttacaggggctagggccaccatcgacgaggcacgtacatcacgcaacncgacctanagtcggacgcgagagaccgagtacgtagaacctagtcgacggaccgaaaccgtaccgggacccttaaagttttaacgttaaccgtggttacggaccggtaaggttacggtttacgggtttaaccccggggtttggggtttcccgtttacggggtttttacccgttttaccgggg

SEQ ID NO: 349204 - DNA, 687 bp, Homo sapiens
  misc_feature: GZ8MTXP02HPV2A.45.37.D04.1.454.CMB.2.raw
  modified_base (412)..(412): a, c, t, g, unknown or other
  misc_feature (412)..(412): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctggaggtgaggaagccgtgggcctcgagtgaggtctcctgcaaggtcttcgtggctaccaccttccgaccggccgactagtcctccacgtggggtcgccgaccgaccggcccccgtaggaccgaagggtccttaggacggtggagtggggatggactaccgaaaccccctaaagtagtgggtacggacaacaaaactgtacgaccaaanaagttaacgtttcggagggtaccgagggttaccaaccagtacggaaccgaacggggtaccaccggtaccaagtccgaacgaccaacgacggtacccctaagtagtacggacgaccgtaggacgacgaagttaccgtaacgaccgtaagttccgtaacggaaaccgtaaccggaaccggtaccctttaaagttttacgttaccgtggtacgtaaccgggtaggttacggtttacggtttaccggggttcgtccggtttttaccggtttttacccgg

SEQ ID NO: 349205 - DNA, 564 bp, Homo sapiens
  misc_feature: GZ8MTXP02JVI5J.45.37.D04.1.454.CMB.2.raw
  modified_base (251)..(251): a, c, t, g, unknown or other
  misc_feature (251)..(251): n is a, c, g, or t
  modified_base (342)..(342): a, c, t, g, unknown or other
  misc_feature (342)..(342): n is a, c, g, or t
  modified_base (365)..(365): a, c, t, g, unknown or other
  misc_feature (365)..(365): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttcnggctacaccttcaccggcgactatctccactgggtgcgacacggcccctggacaagggcttgagtggatgggatggatacaaacccctaanaagtgggtacgacaacaaaactntacgacaacgaagtaagtttcgagggacgaggggtcaaccgagtacgaccgaagggacacgtccatacagacaacacgacctaacgagtagggaagcgtagagacaagactagacctaatcgacgacgacgaacggtacctaatttaactactgtagaacggtagtagttcggtttaccggtgtcgttcggttttaccg

SEQ ID NO: 349206 - DNA, 543 bp, Homo sapiens
  misc_feature: GZ8MTXP02I1M9J.45.37.D04.1.454.CMB.2.raw
  modified_base (361)..(361): a, c, t, g, unknown or other
  misc_feature (361)..(361): n is a, c, g, or t
  modified_base (445)..(445): a, c, t, g, unknown or other
  misc_feature (445)..(445): n is a, c, g, or t
  modified_base (465)..(465): a, c, t, g, unknown or other
  misc_feature (465)..(465): n is a, c, g, or t
  modified_base (499)..(499): a, c, t, g, unknown or other
  misc_feature (499)..(499): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtggggcctcagtgaggtctcctgcagcttctggctacaccttcaccggcgactatctccactgggtgcgacacggcccctggacaagggcttggagtggagtgggatggatcaacccccgtaaacatgggtcgcaacgaaatntgacacgtagaagtttcaggggtcagggtcaacgatcgaccgagggacaccgtacactcgagaccacacgacctacagtggacncgagagcgagactggaaacntacgtagacgacgacggacctaatttactaacgngttacgcgtagtagttcggttacggtcgttcgttcgttttccgg

SEQ ID NO: 349207 - DNA, 561 bp, Homo sapiens
  misc_feature: GZ8MTXP02F09IM.45.37.D04.1.454.CMB.2.raw
  modified_base (365)..(365): a, c, t, g, unknown or other
  misc_feature (365)..(365): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcagtgaggtctcctgcaaggcttctggctacacctcaccggcgactatctccacgtgggtgcgacgacggcccctggacaagggtcttggagtggagtgggatggactaccaaaccccctaagagtggtgacaacaactncacacgagtaagttcgagggcgaggtcacatcgacgaggacacgtcatcacgcacacgacctacacgtggacgcgtagacgacagtactgacagttacgacgaccgacgacggtaccttaacgtttacgttacgtggtagtaacggtaacggtagtttaccggtttaccgggtcggttcgtttcggtttttaccgg

SEQ ID NO: 349208 - DNA, 550 bp, Homo sapiens
  misc_feature: GZ8MTXP02JTQVF.45.37.D04.1.454.CMB.2.raw
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (336)..(336): a, c, t, g, unknown or other
  misc_feature (336)..(336): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcgtgggcctcagtgaggtctcctgcagctcnggctacnccttcaccggcgactatctccactgggtgcgacacggcccctggacaagggcttgagtggagtgggatggatacaacccctaanagtggtagcaacaactgtgacaacagagttcgagggcacgggtcaccagtcgacgaggacacgtacatcagcacgagcctacagtaggagacgtagacggacagactgacagtcgtacgaccggacaccgggtacctagtttacgtaccgtagttacggaaccggtaggtacttacgggtttaaccggtcggttacgtttcggtttttacccgg

SEQ ID NO: 349209 - DNA, 714 bp, Homo sapiens
  misc_feature: GZ8MTXP02I857G.45.37.D04.1.454.CMB.2.raw
  modified_base (255)..(255): a, c, t, g, unknown or other
  misc_feature (255)..(255): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcagtgaaggtctcctgcaggctctggctacncttcaccggcgactatctccactgggtgcgacacggccccgtggacgaggtcttgagtggagtgggatggactaccaaacccctaacgaagtggtacggacaaccgtaaactagtagaccaaacgaagtaaacgtttacgaagggggtccgaacgggggttaccaacccgaagtacggaacccggaacgggggaaacctacccgggtacctaacgtccaacgaccgaaaccgaccggtacccttaaccgtaggttacgggacggtaccgtaggaaccggacgaacggtaaccgtacggaacctaaagttccgtaacggaaaccccgaacggaacccggttacccgttaaatttttaaacgttaccgttaggggtacggtaaccgggtaggggttaaccgtttacgggggtttaaccggggtttcgggttaaccggttttaccgggtttttttacccggg

SEQ ID NO: 349210 - DNA, 520 bp, Homo sapiens
  misc_feature: GZ8MTXP02IUJXY.45.37.D04.1.454.CMB.2.raw
  modified_base (359)..(359): a, c, t, g, unknown or other
  misc_feature (359)..(359): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggccccctggacaagggcttgagtggatgggatggatcaaccccctaacaatggtggcacaaactntgacacagaagtttcgagggcaggggtcaccagtgaccagggacacgtccaatcagcacacgcctacagtgagctgagcaggactgacatctagacgtacacggacctatttacgttactgtgcgtaggtattcggttaccggtggtcgttcggttttccg

SEQ ID NO: 349211 - DNA, 558 bp, Homo sapiens
  misc_feature: GZ8MTXP02GHWY1.45.37.D04.1.454.CMB.2.raw
  modified_base (227)..(227): a, c, t, g, unknown or other
  misc_feature (227)..(227): n is a, c, g, or t
  modified_base (285)..(285): a, c, t, g, unknown or other
  misc_feature (285)..(285): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (402)..(402): a, c, t, g, unknown or other
  misc_feature (402)..(402): n is a, c, g, or t
  modified_base (468)..(468): a, c, t, g, unknown or other
  misc_feature (468)..(468): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtgggctnagtgaggtctctgcaggctctggctacaccttcgaccggcactatcctccacgtgggngcgacgacggccctggacaaggggtcttggagtggagtgggatggactacaacccctaanagtggngacaacaaactgcgacaacgtagtaagttacgagggtacgagggtcaaccngtacgaaccgagggaccaccgtacactcagcactacgacctacgagtggagcagagcgagacgtanactacgtacgacgacgacgaccgtacttacgtttactacgtgtacggaacgtaggtacgttcggttacggtcggttccgtttcggtttcg

SEQ ID NO: 349212 - DNA, 655 bp, Homo sapiens
  misc_feature: GZ8MTXP02IRG2I.45.37.D04.1.454.CMB.2.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctgggcctcagngaggtctctgcaggcttcnggctacaccttcaccggcgactatctccacgtgggtgcgacgacggcccctggacgaagggtcttaggagtggagtgggatggactaccaaacccctaacgaagtgggtaggacaacgtaaactgtacgacaacgaggtaaacgtttcgaacggggtcgaacggggtaccaaccgagtacggaacccgaacgggggacctacccggttccaacgtaccacggaccaacaacggtaccctaacgtacggtggaacgcgtacgaacgacgaacggactacggactacgttaccgaacggaacccgacgacccggtaacctttaaacgttttaacgttaaccgttggtacggaacggtacggtaacgtttacggtttaccgggtcggtttacggttttcggtttttacccgg

SEQ ID NO: 349213 - DNA, 619 bp, Homo sapiens
  misc_feature: GZ8MTXP02HNZ0V.45.37.D04.1.454.CMB.2.raw
  modified_base (239)..(239): a, c, t, g, unknown or other
  misc_feature (239)..(239): n is a, c, g, or t
  modified_base (248)..(248): a, c, t, g, unknown or other
  misc_feature (248)..(248): n is a, c, g, or t
  modified_base (279)..(279): a, c, t, g, unknown or other
  misc_feature (279)..(279): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccacctcccaggtgcagctggtgcagtctggggctgaggtgaggagccgtgggctcagtgaggtctcngcaggctcngctacactcaccggcactatctccactgggngcgacacggcccctggacgaagggcttggaggtggagtgggatggactacccaaaccctaacagtgggtgaccaacgtaactagtacgacaacgtagtaacgtttcgaggggcgtaggggtccaccgagtacggaacccgacggggaacctacggtaccataccgacgaccaaacgaccgacccgttaacgagtacgggaacgccgtaggacgacgaacggtacctaggaactacgtacgtacggaaccgaaccgaccggtacccttaaattttacgttaacgtggtaacggacggtaggtacgtttcggtttaaccgggttcggttacgtttttccggg

SEQ ID NO: 349214 - DNA, 636 bp, Homo sapiens
  misc_feature: GZ8MTXP02G4Z3T.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggagccgtggggcctcgagtgaacggtctcctgacaaggtcttcgtggcctacctacccttcgaccggcgactatcctccacgtgggtcgccgacgaccggccccgtaggaaccgaagggtcttggaggtggagtgggatggactacaaaccccctaacgagtcgggtcggacaaaccaaactgtcgacaaccgaagtaagtttcgaggggtacgacggggtcaaccgatacggaccgaagggacacggtacagtcacgacaacgaccgacctacgagtacgggacgcgtacggagaccgaagtacgacggactacttaccgacggaacccgacgaacccgggtacttaaacgttttactaaccggtgttaggaaccgtaggtacgttacgggttaccggtcggttcgtttacggtttttaccgg

SEQ ID NO: 349215 - DNA, 625 bp, Homo sapiens
  misc_feature: GZ8MTXP02JKFBM.45.37.D04.1.454.CMB.2.raw
  modified_base (507)..(507): a, c, t, g, unknown or other
  misc_feature (507)..(507): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggaagccgtggggcctcgagtgaaggtctccgtgacgaaggtcttcgtggcctacaccttcgaccggcgactatcctccacgtggtcgcgacgacggccccgtggaacgaagggcttggagtggagtgggactggaactaccgaaacccctaaacgaagttgggtacggaccaaacgtaaaacttgacgacaaacgaagtaaagtttaccgaggggtaccgaacggggtaccaaaccacgacggaaccgaacggggaaccaccggtaccaacgacgacgcaaacgacgaccctaanagaggagcgagagaccgaggacagaccatacacggacgaacgaccggtaacctattttactaccgtgtagaacggtaggtacttacggttaccggtcggtcggtttcggttttaccgg

SEQ ID NO: 349216 - DNA, 547 bp, Homo sapiens
  misc_feature: GZ8MTXP02I1N9H.45.37.D04.1.454.CMB.2.raw
  modified_base (433)..(433): a, c, t, g, unknown or other
  misc_feature (433)..(433): n is a, c, g, or t
  modified_base (526)..(526): a, c, t, g, unknown or other
  misc_feature (526)..(526): n is a, c, g, or t
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagcccactcccaggtgcagctggtgcagtctgggggctgaggtgaggaagcctgggggcctcagtgaaggtctcctgcaaggcttctggctacaccttcaccggcgactatctccacgtgggtgcgacacggccccctggacgaagggcttggagtgggagtggggatggatccaaaccctaacaagtggtggacaacaaactatgacaacgagtaagttcgagggcgagggtcacatcgaacgaggacacgtcatcacgcacgacncctacagtggagcgtagacgacgacgacgtagacatcgtacgacgacacggtactagttactacgtgtagacgaagtgttacggtttaccggngtcgttcggtttcgtttacgg

SEQ ID NO: 349217 - DNA, 749 bp, Homo sapiens
  misc_feature: GZ8MTXP02IWKKR.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaacgcccggggctcagtgaaggtctcctgcaaggtcttctggctacaccttcaccggcgactatcctccacgtgggtcgcgacgacgggcccccgtaggaaccgaagggtcgtttaggacggttagggagtggggtagtagggtaactaccgaaaccctaaaccgaagtcgggtacggactaaacgtaaaacttagtcggaccaaacgaaacggtaacgtttacgagggggtaccgtaagggggtaccaaaccgtagtaccggaaaccggaacggggaaccctaaccggttacccaacgtacccgaacgaccgaacgtaaccggacccttaaaccgacgttagggaacgtccgtaggaccgaacaacggtaacgtacggaaacctacgttacggtaacggaaccgaaaccggtaaccgggtaccctttaaagttttaacgtttaaccgtggttacggtaccgggtaaggtacggtttaccgggttttacccggggtggtttacccggtttacgggtttttccgtttttaaccgggg

SEQ ID NO: 349218 - DNA, 588 bp, Homo sapiens
  misc_feature: GZ8MTXP02JI458.45.37.D04.1.454.CMB.2.raw
  modified_base (484)..(484): a, c, t, g, unknown or other
  misc_feature (484)..(484): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctgaggtgaggaagccgtggggcctcgagtgaaggtctcctgcaaggcttctggctacaccttcaccggcgactatcctccacgtgggtgcgacacggcccctaggacagggcttggagtggagtgggatggactacaaacccctaacaagtcggtaggacaacaaactgtgacaacgaggtaacgtttcgaggggtcgaggggtccaaccgagtacggaacccgacggggaccaccggtaccagtcgaacgccaaccgacgacccgtaacacgtagggacgngtacggagacgacgaactggactatcgacgacgaacacggtacctagtttactacgtgtaggaacgtaggtacgtacggttacggtcgtacgtttcgttttccg

SEQ ID NO: 349219 - DNA, 657 bp, Homo sapiens
  misc_feature: GZ8MTXP02JD48Q.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctcctgcaggcttcgtggctacaccttcgaccggcgactatcctccacgtgggtcgcgacacggcccccgtaggaccgaagggtcttaggaggtggagtggggataggactaccgaaaccccctaacgaagtgggtacggacaactaaactgtcgacaacgtaagtaacgtttcgaacggggacgtaacggggtacaacccgaagtacggaacccgaaggggaccacgtaccagtacacgaccacgacgacctaacgagtacgggagaccgtaggaacgacaacggactaggaactacgtacggtacggaaccgaaccggaaccggtaccttaacttttacgttaaccgtggtacggaacggtaaggttacgtttaccgggtttaccggggttcgttaccggttttcggtttttacccg

SEQ ID NO: 349220 - DNA, 661 bp, Homo sapiens
  misc_feature: GZ8MTXP02GD77P.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatcctccactgggtgcgacgcggcccctggacaagggcttggagtggagtgggatggatcaaacccctaacaatgggtaggacaacgaaaactagtcgacaaacaagtaagtttacgaagggggtacaacgggggtcaaacccgtagacggaaacccgaagggggaaaccaccgttaccgaaactccgaacgaccgaacctaacggacccgttaacaacgttgggaaacgtcgtacggacgacaaaggacgttagaacctaaagttccgtacgaaccggaaccgaccgggtaccctaaatttttaacgttaaccgttggttacgaacgggtaacggttacgtttaccggtttacccggggtggttaccgtttcggttttttacccgg

SEQ ID NO: 349221 - DNA, 682 bp, Homo sapiens
  misc_feature: GZ8MTXP02H20NL.45.37.D04.1.454.CMB.2.raw
  modified_base (520)..(520): a, c, t, g, unknown or other
  misc_feature (520)..(520): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggtcttctggctacaccttcaccggcgactactctccacgtgggtcgcgacgacggccccctagggaacgaaggggtcttacggaggtgggagtggggaattgggactaccgaaaccccctaaacgaagttacggggacggacaaaccgaaaacctttagacgaacctaacgaaacgttaaaggtttaccggaaggggtaccgacgggggttaccaacccgagtacggaacccgaggggaacctaccggtaccatacagacacggtacacctaanacgtgggacgcgacgacgcgaaacgcgtaggacacttcgacgaaccgaaccgtaccggtaccttaaatttacgttaacgttacggtacggtaaccggtaacgggttaagtttccgggttttaacccggggtggtttccggtttttacggtttttaccccggg

SEQ ID NO: 349222 - DNA, 529 bp, Homo sapiens
  misc_feature: GZ8MTXP02JXRKU.45.37.D04.1.454.CMB.2.raw
  modified_base (365)..(365): a, c, t, g, unknown or other
  misc_feature (365)..(365): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctgggtgcagtctggggctgaggtgaggagcctgggggcctcagtgaaggtctcctgcaaggctctggctacaccttcaccggcgactatctccactgggtgcgacaggccccctgggacaagggcttgagtggatggggatggatcaaacccccctacaaatgtagggcaacaaactntagcaccgagaagtttcaggggtcagggtcacccgatgacaaggggacacggtccaatcagcacagcctacagtggagctgagcagactgaccatctgacgacacggcccattttacgtactgtgcgaggtattcggtttaccgtggtctttcgggttttaccg

SEQ ID NO: 349223 - DNA, 549 bp, Homo sapiens
  misc_feature: GZ8MTXP02FLI9L.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctgaggtgaggaagcctggggcctcagtgaaggtctcctgcaaggcttctggctacaccttcaccggcgactatctccactgggtgcgacaggcccctggacaagggcttgagtggagtgggatggatcaaccccctaacaatggtggcaacgaaactatgcacagaagtttcagggcagggtcaccatgaccagggacacgtccatcagcacagcctacagtggagctgagcagacgtgacatacctgaaccgacaccgggtacctaagttttaacttaccgtggttagaaccggtaaggtagttacgggttttaacccggtgggtccgtttacgggtttttcccg

SEQ ID NO: 349224 - DNA, 537 bp, Homo sapiens
  misc_feature: GZ8MTXP02JTSKC.45.37.D04.1.454.CMB.2.raw
  modified_base (399)..(399): a, c, t, g, unknown or other
  misc_feature (399)..(399): n is a, c, g, or t
tcagacgcgatcgacacgaccggtgctcgatttagtagcatactgttggggtttgggggcatcaccccagcaaccacatctgtcctctagagaatccccctgagagctccgttcctcaccatggactggacctggaggatcctcttcttggtggcagcagccacaagagcccactccccaggtgcagctggtgcagtctgggggctgaggtgaggaagccgtgggggcctcgagtgaaggtctcctgcaaggcttctggctacaccttcaccggcgactatctccactgggtgcgacacggccccctggacaagggcttgagtggagtgggatggataccaaacctaacagtggtggacaacaaactatgcaacagtaagttcgagggcagggtcacangacgagggacacgccatcagcacagcctaacagtggagctagagacagacgtgacatctaggacgaacgcggtacctatttacttacgtgtgcggtaagagtttcggttacggtggtcgttcggtttccttttacggg

SEQ ID NO: 349225 - DNA, 551 bp, Homo sapiens
  misc_feature: GZ8MTXP02IQIYJ.45.37.D04.1.454.CMB.2.raw
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagcccactccccaggtgcagctggtgcagtctggggctgaggtgaggaagcctgggggcctcagtgaaggtctcctgcaaggcttctggctacaccttcaccggcgactatctccactgggtgcgacaggccccctggacaagggcttgagtgggatggggatgggactacaaacccctaaccaagtggtaggacaacaaaactatgacacagaagtttcgagggcagggtacacagtgaccgagggacacgtccatcagcactagcctacagtggagcgtgaggcagacctagacattcgcgaacgaccacggtcctaagtttacttaccgtgtgcgtaaggtacgttcggtttacggtggtcgtttcggtttaccttttacggg

SEQ ID NO: 349226 - DNA, 633 bp, Homo sapiens
  misc_feature: GZ8MTXP02IYDVG.45.37.D04.1.454.CMB.2.raw
  modified_base (353)..(353): a, c, t, g, unknown or other
  misc_feature (353)..(353): n is a, c, g, or t
  modified_base (377)..(377): a, c, t, g, unknown or other
  misc_feature (377)..(377): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctgaggtgaggaagccgtggggcctcgagtgaaggtctcctgcgaaggcttcgtggctacaccttcgaccggcgactatcctccacgtgggtgcgacgacggccccgtggacgaagggcttggagtggagtgggatggatcaaacccctaanaacgtggtcggacaacgaaaactntcgacaacgaagtaagtttcgagggctaggggaccaacagtacgaaccgaggggtacacgtcagtcagcaacacgcctaacagtaggagacgtagacgaccgaagactacggactacgtacgtacgaaccgaccgaaccggtaacccttaattttaacgttacccgttacggtaggtaaccggtaaaggggttaacgtttaccggggtttaaacccgggtttcgggttaaccggtttcgggtttttttaacccggg

SEQ ID NO: 349227 - DNA, 657 bp, Homo sapiens
  misc_feature: GZ8MTXP02IM84G.45.37.D04.1.454.CMB.2.raw
  modified_base (353)..(353): a, c, t, g, unknown or other
  misc_feature (353)..(353): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcaagcttctggctacaccttcaccggcgactatctccacgtgggtgcgacacggcccctggacgaagggcttggagtggagtgggatgggactaccaaaccctaanaagtggtaggaccaataacctagtacgacaacgaagtaacgtttacgacgggacgaagggtaccaaccgagtacgaaccgacgggaaccgaccgtccaacgtcgaacggcaaccgacggaccttaacgacgtacgggaacgccgtaggaacgacgaacgacgtacgaactacttacgtacggaaccgaccgtaaccgggtacctttaaacttttaaacgttaacgttacggtaacggtaccggtaacgggtttaggtttaccggttttaaccggggtttccgggtttacggttttttcccgggg

SEQ ID NO: 349228 - DNA, 688 bp, Homo sapiens
  misc_feature: GZ8MTXP02FN5LF.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctcctgcaaggcttctggctacaccttcaccggcgactatctccacgtggtgcgacacggccccgtggacaagggcttgaggtggagtgggagtggactacgaaaccccctaaacaagtgggtacggacaacctaaacgtactagaccaaccgaagtaaacggttttacgaagggggacgtaacgggggttacaacccgtagtacggaaccgaacggggaccaccggtaccaactcgaacgccaaccgacgaccctaacgagtacggacggcgtacgacgacgaacgtaccgttacgaactacgttacgtaacgaacccggaacctaaccgggtaccttaaacgtttttactttaaaccggtcggtttacgggaacggtaacgggttaacggtttaccgggtttaaaccggggttacgggtttaccgtttcgggtttttttaaccccggg

SEQ ID NO: 349229 - DNA, 579 bp, Homo sapiens
  misc_feature: GZ8MTXP02JGG4V.45.37.D04.1.454.CMB.2.raw
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttctggctacaccttcaccggcgactatcctccacgtgggtgcgacacggcccctggacaaggcttgagtggatgggatggatacaaacctaacaagtggtaggacaacaaaactatgacaacgtaaaagttcgagggacgagggtcaaccgatacggacgagggacacgtcatcagcacagcctacgagtcggacgcgtaggacacgtagaaccgtgaacacgttaccgagaacccgaacgaccggtacctaaagtttactaacgtggtacgcggtaagtaacgttcggtttacccggtggtctttcggttttaccgtttacggaaccggg

SEQ ID NO: 349230 - DNA, 593 bp, Homo sapiens
  misc_feature: GZ8MTXP02GD4PC.45.37.D04.1.454.CMB.2.raw
  modified_base (276)..(276): a, c, t, g, unknown or other
  misc_feature (276)..(276): n is a, c, g, or t
  modified_base (288)..(288): a, c, t, g, unknown or other
  misc_feature (288)..(288): n is a, c, g, or t
  modified_base (326)..(326): a, c, t, g, unknown or other
  misc_feature (326)..(326): n is a, c, g, or t
  modified_base (486)..(486): a, c, t, g, unknown or other
  misc_feature (486)..(486): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaggtctcctgcaaggcttctggctacaccttcaccggcgactanctccactgggtncgacacggcccctggacaagggcttgagtggatggganggatcccaaaccctaacaagtggtcggacaactaactagtacgcaacgagtaaagtttcgaacggggtcgaaggggtaccaacccgaatcggaacccgaagggggaccctaacggttacccaataccgagaccaacgaacgaccttaacagtacgggganccgaggaacgcgaacgtacaggaacctagtctaggaaccgacgtaaccggacctaagtttactacgtacgtgacgtagtacgttacggtttaccggtggtctttcgg

SEQ ID NO: 349231 - DNA, 541 bp, Homo sapiens
  misc_feature: GZ8MTXP02JN8SP.45.37.D04.1.454.CMB.2.raw
  modified_base (368)..(368): a, c, t, g, unknown or other
  misc_feature (368)..(368): n is a, c, g, or t
  modified_base (502)..(502): a, c, t, g, unknown or other
  misc_feature (502)..(502): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttcgtggctacaccttcaccggcgactatctccacgtgggtgcgacacggcccctggacaagggcttggagtggatggggatggactacaaccccctaacaatgggtcggacaacaaactntgacaacgagaagtttcgagggcagggtcaccgagtcgacgacgggacaccgtccatcgagaccaacgacgacctaacgagtgggacgctagagcaagctagacagtctagacgacgacgactatttacgtacngtagcgtagtactcggttacgtcggtcgttacggtttcg

SEQ ID NO: 349232 - DNA, 574 bp, Homo sapiens
  misc_feature: GZ8MTXP02IWHHG.45.37.D04.1.454.CMB.2.raw
  modified_base (371)..(371): a, c, t, g, unknown or other
  misc_feature (371)..(371): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaggtctcctgcagctctggctacaccttcaccggcgactatcctccactgggtgcgacgacggccccgtggaccgaagggcttggagtggagtgggagtggactaccaaaccccctaactaagtggtacggcaacaaactntcgacaacgagtagtttacgagggcgagggtacacagtacgaccgagggacaccgtcaacgtacacgacaacacgacctacgtagtggacgacgtagacgacgacgacgtgactacgtcgtacgacgacgaccggctaactttacttacgtgtcggaacgtaggtacgttacggttaccggtcggtcgtttcggtttttaccg

SEQ ID NO: 349233 - DNA, 624 bp, Homo sapiens
  misc_feature: GZ8MTXP02GKSLL.45.37.D04.1.454.CMB.2.raw
  modified_base (252)..(252): a, c, t, g, unknown or other
  misc_feature (252)..(252): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttcnggctaccaccttcaccggcgactatcctccacgtgggtcgcgacgacggcccccgtaggacgaagggtcttaggagtggagtgggatggaataccaaacccctaacaagtgggtacggacaaacaaactatcgacaacgtaagtaacgtttacgagggcgaacgggtaccaccgagtacgaaccgacggggaaccaccggtacaactcgaacgcaacacgacctacgagtcggaagcgacgacgacaaggactacggaactactaccgtacgaaccgaaccgaccggtaaccttaattttacgtaacgttcggtagaacggtaaggtacgtttacgggtttacccggtggttccgtttacggtttttaccgg

SEQ ID NO: 349234 - DNA, 588 bp, Homo sapiens
  misc_feature: GZ8MTXP02JW3QN.45.37.D04.1.454.CMB.2.raw
  modified_base (366)..(366): a, c, t, g, unknown or other
  misc_feature (366)..(366): n is a, c, g, or t
  modified_base (447)..(447): a, c, t, g, unknown or other
  misc_feature (447)..(447): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatctccactgggtgccgacacggcccctggacaagggcttggagtggatgggatggatccaaaccccctaacaagtggtaggcaacaaactntgacacagtaagttcgaggggcagggtcaccgagtacgaccgagggacacgccatcagcacacgacctacagtcggagtcngacgacaaggacctaggaacctagttccgtacggaaccgaccgaaccggtacctaacttttacgttaccgttggtacggaaccggtaggtaacgtttcgggttttaacccgggtggttaccgtttcgggtttttaccccgg

SEQ ID NO: 349235 - DNA, 598 bp, Homo sapiens
  misc_feature: GZ8MTXP02GXMQT.45.37.D04.1.454.CMB.2.raw
  modified_base (359)..(359): a, c, t, g, unknown or other
  misc_feature (359)..(359): n is a, c, g, or t
  modified_base (423)..(423): a, c, t, g, unknown or other
  misc_feature (423)..(423): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctgaggtgaggaagcctggggcctcagtgaaggtctcctgcaaggcttctggctacaccttcaccggcgactatctccactgggtgcgacacggcccctggacaaggctgagtggagtggatggatcaaacccctaagaatggtggacaacaaactntgacacagtaacgtttcaggggtcagggtcaaccgatacggacaggggacacgtaccatacganacaacacgaccctaacgacgtgggaacgccgtagaacgacgaacgaacgttggaactacgttaccgtacgaacccgacgtaaccgggtaccttaagtttaacgttaacgtggttacgaacgggtaaggtacgtttacgggtttaccggtcggttccgttttcgggtttttacccg

SEQ ID NO: 349236 - DNA, 650 bp, Homo sapiens
  misc_feature: GZ8MTXP02ITB0H.45.37.D04.1.454.CMB.2.raw
  modified_base (259)..(259): a, c, t, g, unknown or other
  misc_feature (259)..(259): n is a, c, g, or t
  modified_base (298)..(298): a, c, t, g, unknown or other
  misc_feature (298)..(298): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagcgtggtgcagtcgtggggctggaggtgaggaagccgtggggcctcgagtgaaggtctcgtgacgaaggcttcgnggtctacaccttcaccggcgaactatcctccagtgggtncgacgacggcccctggacgaggtctggagtggagtgggatggactaccaaacccctaacgaagtggtcgacgaacaaaactgtacgactaacgagtaacgtttcgaggggacgacggggtacaccgtagtacgaaccggaacgggaccaccggtccaatccgagccaaaccgacgtaccctaacgtagtacgggaacggaccgtagaacggtacgtaacgacgttacggaactacgtacgtacgaaacccggtaacgaccggtaccttaaagtttacgttacggtagtacggtaacggtaggttacgtttacggtttaaccgggtcgtttccggtttacggtttttaaccgg

SEQ ID NO: 349237 - DNA, 584 bp, Homo sapiens
  misc_feature: GZ8MTXP02JRJF0.45.37.D04.1.454.CMB.2.raw
  modified_base (468)..(468): a, c, t, g, unknown or other
  misc_feature (468)..(468): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctgaggtgaggaagcgtgggcctcgagtgaggtctctgcaaggcttctggctacaccttcgaccggcgactatcctccacgtgggtcgcgaccgacggccccctaggacgaagggtctttggaggtggagtgggatggactacccaaacccctaagagtggtagacaacaactatgacaacgagtaacgtttcgagggacgacgggtcaccgagtacgaccgaggaccacgtacactacacgaccacacgacctacgagtggganacgtggagaccgagacctagacaactcgtacgaacgaccgacggtaccttaatttacgttacgagttcggacggtacggtacgttacgggtttaccggtaggttccgttttacggg

SEQ ID NO: 349238 - DNA, 622 bp, Homo sapiens
  misc_feature: GZ8MTXP02FPW18.45.37.D04.1.454.CMB.2.raw
  modified_base (257)..(257): a, c, t, g, unknown or other
  misc_feature (257)..(257): n is a, c, g, or t
  modified_base (372)..(372): a, c, t, g, unknown or other
  misc_feature (372)..(372): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcgagtgaggtctctgcagcttctggctacnccttcaccggcgactatctccactgggtcgcgacgacggccccgtggacgaagggcttgagtggagttggggatggactacaaccccctaaacaagtgggtaggacaacaaactntagaccaacgaaggtaaacgtttcgaggggtacgaacggggtccaaccgtagtacgaaccgaaggggaccaccggtacctaacgcaacgaccaaaccgaccggacccttaacgacgttagggacgtaccgtaggacgaccgaagtacgacgaactagtccgacggaccgacgacggaccttaagtttacttacgtgtacgaacggtaagtacgttacggtttaccggtcggtcgtttcggtttttaccgg

SEQ ID NO: 349239 - DNA, 651 bp, Homo sapiens
  misc_feature: GZ8MTXP02GOFTI.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggacgccgtgggcctcgagtgaggtctccgtgacgaggtcttcgtggctaccaccttcgaccggcgtaactactcctacctacgtgggtcgacgacgaccggccccgtaggaacgagggtcgttaggaggtggagtgggagtggactaccaaacccctaagagtggtacgacaacgaaactgtacgactagagttacgttacgagggacgtacggtacacgagtacgaccgagggacctaccgtcacgtacgacgaccgaacacggtaccctacgtagtacgggacgtacgacggacgacgaaggaccttaggaacctacgttccgtaacggacccgtaaccggaccggttacctttaacgtttaacgttacgtggtacggaaccggtaaggttacgtttacgggttccggtacggttccggttttacggtttttcccgg

SEQ ID NO: 349240 - DNA, 550 bp, Homo sapiens
  misc_feature: GZ8MTXP02HAKMX.45.37.D04.1.454.CMB.2.raw
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (352)..(352): a, c, t, g, unknown or other
  misc_feature (352)..(352): n is a, c, g, or t
  modified_base (444)..(444): a, c, t, g, unknown or other
  misc_feature (444)..(444): n is a, c, g, or t
  modified_base (532)..(532): a, c, t, g, unknown or other
  misc_feature (532)..(532): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttcnggctacnccttcaccggcgactactctccacgtgggtgcgacgacggcccctagggaccaagggcttggaggtggagtgggatggactacaacccctaanaagtggtgacacaaactgtgacacgagtagttcagggcagggtcacatagaccgagggacacgtcagtcagcagacgacctacagagggacncgtacgagacaaggactagacaagtcgtacggacgacgacggactaagtttactacgtgtcgaacggtaggtattacggtttaccggnggttcgttcggtttttcg

SEQ ID NO: 349241 - DNA, 535 bp, Homo sapiens
  misc_feature: GZ8MTXP02JWGIV.45.37.D04.1.454.CMB.2.raw
  modified_base (362)..(362): a, c, t, g, unknown or other
  misc_feature (362)..(362): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcagtgaaggtctcctgcaggcttctggctacaccttcaccggcgactatctccactggtgcgacacggcccctggacaagggcttgagtggagtgggatggatcaaaccccctaacaagtggtggcaacaaactntgcaacgagaagtttcgagggcacgggtcacagtcgaccgaggacacgtcatcagcacacgacctacagtaggacgcgtagagcgtaagacgtgacatcgtacgacgacgaccggactactttactactgtacggcgaggtacgttcggttaccggtgtccgttgttttccgg

SEQ ID NO: 349242 - DNA, 519 bp, Homo sapiens
  misc_feature: GZ8MTXP02G0OQZ.45.37.D04.1.454.CMB.2.raw
  modified_base (224)..(224): a, c, t, g, unknown or other
  misc_feature (224)..(224): n is a, c, g, or t
  modified_base (285)..(285): a, c, t, g, unknown or other
  misc_feature (285)..(285): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggctnagtgaaggtctcctgcaaggcttctggctacaccttcaccggcgactatctccactgggtncgacaggcccctggacaagggcttgagtggatgggatggatcgaaacccctaacaagtggtaggacaacgaaactgtgacaacagtaagtttcgaagggcagggtcaaccagtgaccagggacacgtcatcagcagacgacctacatggagctagagcagactgacagtcagacgacacggcctaatttactactgtagaagagtatcggttacgtcggtcgtttcggtttccg

SEQ ID NO: 349243 - DNA, 656 bp, Homo sapiens
  misc_feature: GZ8MTXP02GA4WU.45.37.D04.1.454.CMB.2.raw
  modified_base (257)..(257): a, c, t, g, unknown or other
  misc_feature (257)..(257): n is a, c, g, or t
  modified_base (276)..(276): a, c, t, g, unknown or other
  misc_feature (276)..(276): n is a, c, g, or t
  modified_base (373)..(373): a, c, t, g, unknown or other
  misc_feature (373)..(373): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtgggcctgagtgaggtctcctgcaaggcttctggctacncctcgaccggcgactatcnccacgtggtgcgacgacggcccctggacgaagggtcttggagtggagttgggataggactaccaaacccctaacaagtggtacggacaacaaaactntgacaaacgagtaacgtttacgagggccgtagggtaccaacgagtacggaaccgaacggggaaccacggtacccaagtcgaacgaccaaacgaccggaccctaacgaagttgggacgtaccggtagaggaccgttaacgaacgttacggaaactacgttaccggtacgaaacccggaccgtaaccgggtaccctttaaacgttttagttaaccgttggttacgaaccggtaggttacgtttacgggtttaccggtcggttaccggttttcgtttttacccggg

SEQ ID NO: 349244 - DNA, 674 bp, Homo sapiens
  misc_feature: GZ8MTXP02IXTKG.45.37.D04.1.454.CMB.2.raw
  modified_base (253)..(253): a, c, t, g, unknown or other
  misc_feature (253)..(253): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggctgaggtgaggaagccgtggggcctcgagtgaaggtctcctgcaaggcttcgnggctacaccttcaccggcgactatcctccacgtgggtgccgacgacggcccccgtaggaaccgaagggtcttaggaggtgggagtggggattgggaactaccgaaacccctaaacgaagttgggtacggacaaactaaactgtcgacaacaaggtaacgtttacgacgggggtctaggggtccaaccgtagtacggaacccgtaagggaccgtaccggtaccaacgtaccgacgaccaaacgacggtaccctaacgtagttacgggagaccgtagacgaccgaagtaacgtaggaactacgtaccgtaacggacccgaaccgtaccgggtaccttaacgtttttactacgttcggtacggtaacggtaggttacgtttacgggtttaccgggtcggtttaccggtttacggtttttcccgg

SEQ ID NO: 349245 - DNA, 616 bp, Homo sapiens
  misc_feature: GZ8MTXP02HDA7W.45.37.D04.1.454.CMB.2.raw
  modified_base (295)..(295): a, c, t, g, unknown or other
  misc_feature (295)..(295): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcaaggcttctggctacaccttcaccggcgactatcctccacgtgggtncgacacggcccctaggacaagggcttaggagtggagtggggatggtataccccaaaccctaacgaagtggggtggacaacaacgttagtagaccaacgaagtaacggtttcacggggtacgaagggttccaacccgagtacgaacccgagggaccaacgtccaagtcagaccacgacgacctagagtgggacgcgtggaagaccgagacctaggactagttaccgagaccggtaacgaaccggtacccttaagtttacttacgttaggtcgacggtaaggtacgtttacgggtttaccgggtcggtaccgtttttccgggg

SEQ ID NO: 349246 - DNA, 551 bp, Homo sapiens
  misc_feature: GZ8MTXP02GU3M2.45.37.D04.1.454.CMB.2.raw
  modified_base (363)..(363): a, c, t, g, unknown or other
  misc_feature (363)..(363): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaggtctcctgcaggcttctggctacaccttcaccggcgactatcctccacgtgggtgcgacacggcccctggacaaggcttgagtggagtgggatggactacaaccccctaacagtggtggacaacaaactntgacacgagtaagtttcgagggcgaggtcaccgatcgacgagggacacgtacatcgagcacacgacctacagtggacgctaggacgcagtactagacagtcgacgacgacgaccggtacctaatttacgttacgtgtacgcggtaggtacgtttacggttaccggtcggtcgtttcggttttacccgg

SEQ ID NO: 349247 - DNA, 653 bp, Homo sapiens
  misc_feature: GZ8MTXP02F7STI.45.37.D04.1.454.CMB.2.raw
  modified_base (253)..(253): a, c, t, g, unknown or other
  misc_feature (253)..(253): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcgagtgaaggtctctgcaaggcttcnggctacaccttcaccggcgactatctccacgtggtgcgacacggcccctggacaagggcttgagtggagtgggatggatccaaacccctaacaagtggtacggacaacaaaactgtcgacaacgaagtaacgtttacgaaggggtcaaggggtccaacccgaagtacgaaccgaggggaacaccggtaccatacaacgcaacgacgacctaacgagtagggaagccgtaggacgacaacggtactaggaacgtacttacgtacggaacccgaaacgaacccggtaaccttaaacttttaacgttaaccgttggttaacggaaccggtaaagggttaacgtttaccgggggttttaaacccgggtcggggtttacccgttttacggggttttttaccccgg

SEQ ID NO: 349248 - DNA, 654 bp, Homo sapiens
  misc_feature: GZ8MTXP02JN570.45.37.D04.1.454.CMB.2.raw
  modified_base (250)..(250): a, c, t, g, unknown or other
  misc_feature (250)..(250): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcagtgaggtctcctgcaggcttcnggctacaccttcgaccggcgactagtcctccacgtgggtcgccgacgacggccccgtggacgaaggtcttgaggtggagtgggatggacttacaaacccccgtagaacgtggtacggacaactaaactgtacgactaacgtaagtaacgtttcggaagggaccgtacggggtaccacccgtaagtacggaacccggtaaggggacccacccggttactaacgcgaacgccacgaaccgctaacgtagtagggacgtcgtaggacgacgacgactacggaactaacgttccgtacggaaccgaccggaccggtaacccttagttttaacgtaccgttggtacggtaaccggaaggttacgtttacggggtttaacccggtggttccgttttacggtttttcccgg

SEQ ID NO: 349249 - DNA, 584 bp, Homo sapiens
  misc_feature: GZ8MTXP02HWOWJ.45.37.D04.1.454.CMB.2.raw
  modified_base (291)..(291): a, c, t, g, unknown or other
  misc_feature (291)..(291): n is a, c, g, or t
  modified_base (526)..(526): a, c, t, g, unknown or other
  misc_feature (526)..(526): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagcgtgggcctgagtgaggtctctgcgaggctctggctacaccttcaccggcgactactctccagtgggtgcgacncggcccctggaccgaagggcttaggagtggagtgggatggataccaacccctaagacgtggtagacaacaaactgtgacaacgtagtaagttcgagggtcgacggtaccaccgagtacgacgaggactacgtaccagacacgacacacgaccctagtagtaggacgctagacgaccgagtacgtacgaacacgtacgtacggaaccgtacgacgtaccttaagtttacgttacgngttacgaacggtaggtaacgtttcgggttacggttcggtcgttttcgtttttacccgg

SEQ ID NO: 349250 - DNA, 526 bp, Homo sapiens
  misc_feature: GZ8MTXP02IYQV7.45.37.D04.1.454.CMB.2.raw
  modified_base (344)..(344): a, c, t, g, unknown or other
  misc_feature (344)..(344): n is a, c, g, or t
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcgtggggctcagtgaaggtctcctgcaaggcttctggctacgaccttcaccggcgactatctccactgggtgcgacacggcccctggaccaagggcttgagtggatgggatggatcgaaccccctaaanaagtggtaggcaacaaaactatcgacaacagaagtttcgagggcagggtcaccatacgacaagggacacgtcatcagcacagacctacatggagcngagcagacngacatcagacgacacggacctatttactactgtagaacgaggtattcggttaccggtcggtcgttcggtttttaccg

SEQ ID NO: 349251 - DNA, 574 bp, Homo sapiens
  misc_feature: GZ8MTXP02JP8D8.45.37.D04.1.454.CMB.2.raw
  modified_base (362)..(362): a, c, t, g, unknown or other
  misc_feature (362)..(362): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctggggcctcagtgaaggtctcctgcaaggcttctggctacaccttcaccggcgactatctccactgggtgcgacacggcccctggacaagggctggagtggatgggatggatcaacccctaacaagtggtaggacaacaaactntgacacagaagtttcgagggacgagggtccaccgtatgaccgagggacaccgtaccatcacgcacagacctacagtggagcctaggacgaccaggactacgacatacctggaccgaacgaccgggtctaaacttttacgtaccgttggtacggtaaccggtaaggttacggttacggtttaccgggtacggtcggtttacggtttttcccgg

SEQ ID NO: 349252 - DNA, 568 bp, Homo sapiens
  misc_feature: GZ8MTXP02HYJ59.45.37.D04.1.454.CMB.2.raw
  modified_base (227)..(227): a, c, t, g, unknown or other
  misc_feature (227)..(227): n is a, c, g, or t
  modified_base (363)..(363): a, c, t, g, unknown or other
  misc_feature (363)..(363): n is a, c, g, or t
  modified_base (397)..(397): a, c, t, g, unknown or other
  misc_feature (397)..(397): n is a, c, g, or t
  modified_base (422)..(422): a, c, t, g, unknown or other
  misc_feature (422)..(422): n is a, c, g, or t
tcagacgcgatcgacacgaccggtgctcgatttagtagcatactgttgggtttggggagcatcacccagcaaccacatctgtcctctagagaatccccctgagagctccgttcctcaccatggactggacctggaggatcctcttcttggtggcagcagccacaagagcccactccccaggtgcagctggtgcagtctggggctgaggtgaggaagcctggggcctnagtgaggtctcctgcaaggcttctggctacaccttcaccggcgactatcctccactggggtgcgacgacggcccctggacaagggcttgagtggatgggatgggatcaacccctaacaatggtcggcaacaaactntgcacgagaagttcagggcagggtcacatcgacngggacacgtcatcagcacagcctantggacgctagcgacagacgtagacagttcgaggaccgaccgacggtaccctaagtttttaactaccgttaggttacggaaccggtaagggtaacgtttcggggttttaaccggggtggttaccgttttacggggttttttccccgg

SEQ ID NO: 349253 - DNA, 568 bp, Homo sapiens
  misc_feature: GZ8MTXP02JKDKC.45.37.D04.1.454.CMB.2.raw
  modified_base (256)..(256): a, c, t, g, unknown or other
  misc_feature (256)..(256): n is a, c, g, or t
  modified_base (366)..(366): a, c, t, g, unknown or other
  misc_feature (366)..(366): n is a, c, g, or t
  modified_base (463)..(463): a, c, t, g, unknown or other
  misc_feature (463)..(463): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaggtctcctgcaggcttctggctacnccttcaccggcgactatcctccacgtgggtgcgacgacggccccgtggacgaagggcttggagtggagtgggatggataccaacccctaacgaatggtggcaacaaactntgacacgagtaagttcgagggcagggtcaccgatcgacagggacacgtcatcacgcacgacgctacgagtgggacgcgtgagcaaggactagaactntacgtacggaccgaccgaccggtacctaacgttttacgttaaccgtggtacggaacgtaggtaacgtttcggtttaaccggtggtttccggttcggtttttcccg

SEQ ID NO: 349254 - DNA, 543 bp, Homo sapiens
  misc_feature: GZ8MTXP02JTT8J.45.37.D04.1.454.CMB.2.raw
  modified_base (357)..(357): a, c, t, g, unknown or other
  misc_feature (357)..(357): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctgggggcctcagtgaaggtctcctgcaaggcttctggctacaccttcaccggcgactatctccacgtgggtgcgacaggccccctggacaagggcttgagtggatgggatggatcaacccctacatggtggacacaaactntgcacagtaagttcgagggcagggtcaccatcgacagggacacgtcatcagcacagccctaagatgggacgctgacgcagtacttacatcgtgaacgacaccggtcctaatttacgttactggttacgacggtaagggtacttacgggtttaccgggtggttcggtttcggtttccgtttttacgg

SEQ ID NO: 349255 - DNA, 557 bp, Homo sapiens
  misc_feature: GZ8MTXP02H8HFM.45.37.D04.1.454.CMB.2.raw
  modified_base (376)..(376): a, c, t, g, unknown or other
  misc_feature (376)..(376): n is a, c, g, or t
  modified_base (407)..(407): a, c, t, g, unknown or other
  misc_feature (407)..(407): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgcaagtccagccagagtgttttagacagctaccaaacaataagaactacttagcttggtaccagacagaaaccaggtcacgcctactaagctgctctatttacgtggcacgtccgtacccgggaacgtcccggggtcccctcgaccgtattcgagtggcngggccgggtcgtagggacagtatttcactcncaccatcagcacgcctgccgagctaggaaagtcgtgtggacttaggtttagtgcgtagtcgagtactaatttaattattatacttccgtccgtacgtttcggccgtacgggaacctaagtgaatacgtaacaaacgtactggacgctacg

SEQ ID NO: 349256 - DNA, 616 bp, Homo sapiens
  misc_feature: GZ8MTXP02IENAK.45.37.D04.1.454.CMB.2.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (289)..(289): a, c, t, g, unknown or other
  misc_feature (289)..(289): n is a, c, g, or t
  modified_base (356)..(356): a, c, t, g, unknown or other
  misc_feature (356)..(356): n is a, c, g, or t
tcagacgcgatcgacacgaccggtgctcgatttagtagcatactgttgggtttggggagcatcacccagcaaccacatctgtcctctagagaatccccctgagagctccgttcctcaccatggactggacctggaggatcctcttcttggtggcagcagccacaagagcccactcccaggtgcagctggtgcagtctggggctggaggtgaggagccgtggggcctnagtgaaggtctcctgcaggcttcnggctacaccttcgaccggcgactatctccacgtgggtncgacgacggccccctaggacgaagggtccttaggagtggagtggggatggactacaaaccccctaanaagtggtaggacaacaactagtcgacacagtaagtttcgaggcgagtcacagtcgaccgaggacacgtcatcgagcacacgcctacagtaggagcgtagacgacaacggactagaccgagtaccgtacggaaccgaccgtaccgggtaacctttacttttaaacgttacccgttaggtacggaaccggttaagggttaacgtttaccggggtttaacccggggttcggtttaccgtttttacgggttttttaaccccggg

SEQ ID NO: 349257 - DNA, 524 bp, Homo sapiens
  misc_feature: GZ8MTXP02HL1O6.45.37.D04.1.454.CMB.2.raw
  modified_base (272)..(272): a, c, t, g, unknown or other
  misc_feature (272)..(272): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
  modified_base (363)..(364): a, c, t, g, unknown or other
  misc_feature (363)..(364): n is a, c, g, or t
  modified_base (366)..(366): a, c, t, g, unknown or other
  misc_feature (366)..(366): n is a, c, g, or t
  modified_base (387)..(387): a, c, t, g, unknown or other
  misc_feature (387)..(387): n is a, c, g, or t
  modified_base (402)..(402): a, c, t, g, unknown or other
  misc_feature (402)..(402): n is a, c, g, or t
  modified_base (406)..(406): a, c, t, g, unknown or other
  misc_feature (406)..(406): n is a, c, g, or t
  modified_base (426)..(426): a, c, t, g, unknown or other
  misc_feature (426)..(426): n is a, c, g, or t
tcagacgcgatcgacacgaccggtgctcgatttagtagcatactgttggggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctgggggcctcagtgaaggtctcctgcaaggcttctggctacaccttcaccgggnactatctccactgggtgcgacaggccccctggacaaggggcttgagtggatgggatggatcaaccccctaanaatggngcacaaactntannanagtaagtagagagagacacanagacgagacacacanacanacacacgacacagagagacngagacacgacagacactactacgacgaacgacgactaactttaacttacgtagtagaacgaggtacgttacggttacggtacggtacgtttcgtttcg

SEQ ID NO: 349258 - DNA, 593 bp, Homo sapiens
  misc_feature: GZ8MTXP02JKZK6.45.37.D04.1.454.CMB.2.raw
  modified_base (368)..(368): a, c, t, g, unknown or other
  misc_feature (368)..(368): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatctccacgtgggtgcgacacggcccctggacgagggcttggagtggagtgggatggactcaaaccccctaacaagtggtggacaacgaaactntcgacacgtagaagtttcgagggcaggggtcaaccgatcgaccgagggacacgccagtcagcaacgacgacctaacacgtagggacgctaggacgacgaagactagactagttcgacgaaccgaccgaccggtaccttaaagttttacgttaccgtggtagaaccggtaaggtacggtttaccggtttaaccggggttcggttaccggtttcggtttttacccgg

SEQ ID NO: 349259 - DNA, 598 bp, Homo sapiens
  misc_feature: GZ8MTXP02IBKRZ.45.37.D04.1.454.CMB.2.raw
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
  modified_base (284)..(284): a, c, t, g, unknown or other
  misc_feature (284)..(284): n is a, c, g, or t
  modified_base (455)..(455): a, c, t, g, unknown or other
  misc_feature (455)..(455): n is a, c, g, or t
tcagacgcgatcgacacgaccggtgctcgatttagtagcatactgttgggtttggggagcatcacccagcaaccacatctgtcctctagagaatccccctgagagctccgttcctcaccatggactggacctggaggatcctcttcttggtggcagcagccacaagagcccactcccaggtgcagctggtgcagtcgtgggctgaggtgaggagcgtgggctnagtgagtctctgcagtctntggctacacctcaccggcgactactctccacgtggtgcgacncggccccgtggacgaagggtcgttggaggtggtagtgggagtgggactaccgaaaccccctaaacaaacgtgggtacggacaacgaaactatgacacgagtaagttcgaggtcgacgggtacacgagtacgacgacggacacgtcactcacgcacgacgtaccacgtaagnggtacgacgagacgacacggacgtacgaacgtacgtacgacggaaccgacgtaaccggtaccttaactttaacgttaccgtagttcggaacgtaaggtcgttaacggtttcgggttacggttcggtttacgtttttacccggg

SEQ ID NO: 349260 - DNA, 556 bp, Homo sapiens
  misc_feature: GZ8MTXP02GQZJ7.45.37.D04.1.454.CMB.2.raw
  modified_base (350)..(350): a, c, t, g, unknown or other
  misc_feature (350)..(350): n is a, c, g, or t
  modified_base (369)..(369): a, c, t, g, unknown or other
  misc_feature (369)..(369): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcagtgaaggtctcctgcaaggcttctggctacacccttcaccggcgactatcctccacgtgggtgcgacgacggcccctggacaagggtcttggaggtggagtgggatggatacaacccctaanagtggtacgcaacaaactntgacaacgagtaagttcgagggcagggtcacagtacgacgaggacacgtcatcagcacacgacctacacgtggagctgagcagactgacatcgtacgacgaccgtacggaccttaatttacgttacgtgtacggaacggtaggttacgttacggggtttacggtcggttacgtttcgggttttaccg

SEQ ID NO: 349261 - DNA, 554 bp, Homo sapiens
  misc_feature: GZ8MTXP02HFFI7.45.37.D04.1.454.CMB.2.raw
  modified_base (346)..(346): a, c, t, g, unknown or other
  misc_feature (346)..(346): n is a, c, g, or t
  modified_base (368)..(368): a, c, t, g, unknown or other
  misc_feature (368)..(368): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttctggctacaccttcaccggcgactatctcactgggtgcgacaggcccctggacaagggctgagtggatggggatgggataccaaacccctaanaagtgggtcggacaacaaactntagacacgaagtaagtttcaggggcagggtacacagtgaaccgagggacacgtacactcagacacgagcctaacagtagacgctgacgacaggacctagaacatcgacgacacgaccggcaactttacttaacctggtaacgacgtaacggtagttacggtttaccgggtcggtacgttttccggg

SEQ ID NO: 349262 - DNA, 664 bp, Homo sapiens
  misc_feature: GZ8MTXP02IR936.45.37.D04.1.454.CMB.2.raw
  modified_base (316)..(316): a, c, t, g, unknown or other
  misc_feature (316)..(316): n is a, c, g, or t
  modified_base (375)..(375): a, c, t, g, unknown or other
  misc_feature (375)..(375): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggtgagagggccaccatcaactgcaagtccagccagagtgtttagacagctacaaacaataagaactactagcttaggaccagacaagaaaccagtcacgcctacaagctgctcatttacgnggactactaccgtacccgggaagtcccggggtacccctcgaccgtattcgaggtcggcncgggtcgggtcgtagggactagtactttaccgaccttctaccaaccactaccgacggtacctaacgtccccgtgacccgaagggcgttaagaaagtagttcggtacggtacttaggttttaagtcgtacgttacgtacgtaagtaacttaaatttaaactttaattaacgtttaactttcccccgttacggttaacccgttttcccggggaccctttacgggggaaaccttaaaggttccggtaaattaacgtaaccgtaaaaccggtattcgggtacggtaccttacg

SEQ ID NO: 349263 - DNA, 569 bp, Homo sapiens
  misc_feature: GZ8MTXP02HYI48.45.37.D04.1.454.CMB.2.raw
  modified_base (452)..(452): a, c, t, g, unknown or other
  misc_feature (452)..(452): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggctgaggtgaggagcctggggctcagtgaggtctcctgcagctctggctacaccttcaccggcgactatcctccactgggtgcgacgacggcccctggaccgaagggtcttggaggtggagttggggattggagtaccaaaccccctaaacaagtgggtaaggaacaaaactatgacaacaagtacgtttacgagggcaggggtcaaccgatacgaccgagggacacggtacccatacagacacacgccctanagtaggagctagagcagtacagacaatctacggacgacgacggtacctaagttttacttaccgtcgttgacggtaagtacgttacggtttaccggtggtcttcggttttcctttagg

SEQ ID NO: 349264 - DNA, 566 bp, Homo sapiens
  misc_feature: GZ8MTXP02F0CKA.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatctccactgggtgcgacacggccccctggacaagggcttggagtggagtgggatggatccaacccctaacaatggtaggacaacaaactatcgacacagtaagtttacgagggcagggtcaccatcgacgagggacacgtacatcagcaacacgacctacagtaggacgcgtagaggcaaggactcgaactacgtcgtacggaccgacgaccgggtaccttatttaacttacgtgttagaacgtacggtagttacggttaccggtcggtccgtttacggtttttaacccgg

SEQ ID NO: 349265 - DNA, 529 bp, Homo sapiens
  misc_feature: GZ8MTXP02FN2X4.45.37.D04.1.454.CMB.2.raw
  modified_base (278)..(278): a, c, t, g, unknown or other
  misc_feature (278)..(278): n is a, c, g, or t
  modified_base (431)..(431): a, c, t, g, unknown or other
  misc_feature (431)..(431): n is a, c, g, or t
  modified_base (439)..(439): a, c, t, g, unknown or other
  misc_feature (439)..(439): n is a, c, g, or t
  modified_base (507)..(507): a, c, t, g, unknown or other
  misc_feature (507)..(507): n is a, c, g, or t
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagcccactccccaggtgcagctggtgcagtctgggggctgaggtgaggaagcctgggggcctcagtgaaggtctcctgcaaggcttctggctacaccttcaccggcgactanctccactggggtgcgacaggccccctggaccaaggggcttgagtggatggggatggatcaaccctaacatggtggcacaaaactatgacacagaagtttcgagggcagggtcaccatgacaggacacgtcatcagcacagcctacactagganctagacgnaggactgaccatctgacgacgacggcctaatttattactgtagacgaaggtagttacgtttaccgggngtcgttcggtttctttttacgg

SEQ ID NO: 349266 - DNA, 519 bp, Homo sapiens
  misc_feature: GZ8MTXP02ICCRU.45.37.D04.1.454.CMB.2.raw
  modified_base (249)..(249): a, c, t, g, unknown or other
  misc_feature (249)..(249): n is a, c, g, or t
  modified_base (316)..(316): a, c, t, g, unknown or other
  misc_feature (316)..(316): n is a, c, g, or t
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
  modified_base (461)..(461): a, c, t, g, unknown or other
  misc_feature (461)..(461): n is a, c, g, or t
  modified_base (467)..(467): a, c, t, g, unknown or other
  misc_feature (467)..(467): n is a, c, g, or t
  modified_base (503)..(503): a, c, t, g, unknown or other
  misc_feature (503)..(503): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgtttagacagctacaanaataagaactactagcttaggtaccagcaagaaacaggtcacgcctctaagctgctactatttacgnggctagtccgtaacccggggtaacgtcccggggtccccacgaccgtattccgaggtcggcgacggcggggtcacggggacctagtactttcactctacactacncagcagcngcaggcagatatgtgatagttagtgctgcaagntaaatnttatatactctcgtactcgctacggacagtgaatanacaacgactgcgctcg

SEQ ID NO: 349267 - DNA, 667 bp, Homo sapiens
  misc_feature: GZ8MTXP02HVPKA.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagctgggctcagtgaaggtctctgcaaggctctggctacaccttcaccggcgactatctccactgggtcgcgacacggcccctaggaccgaagggcttggagtggagtggggatggataccaacccctaaacgaagtcggtaggactaaccgaaaactgtacgaccaacgtagtaaagggtttacgaggggtaccgaacgggggttaccaaccggaacgttacggaacccggaaggggaaccgtacccggttaccaacgtccaagaccaacgaacgacccttaacgagttacgggagtaccgtagacgacgaacggacttacggaacgtactacgtacggaaccgaacgtaacccgggtaccttaaacgttttacgtaccgttaggtacggtaaccggtaaggtaacggtttacgggtttaacggttacgggttcgttttacggttttttcccgg

SEQ ID NO: 349268 - DNA, 558 bp, Homo sapiens
  misc_feature: GZ8MTXP02ITCMZ.45.37.D04.1.454.CMB.2.raw
  modified_base (363)..(363): a, c, t, g, unknown or other
  misc_feature (363)..(363): n is a, c, g, or t
  modified_base (428)..(428): a, c, t, g, unknown or other
  misc_feature (428)..(428): n is a, c, g, or t
tcagacgcgatcgacacgaccggtgctcgatttagtagcatactgttgggtttgggggcatcaccccagcaaccacatctgtcctctagagaatccccctgagagctccgttcctcaccatggactggacctggaggatcctcttcttggtggcagcagccacaagagccccactccccaggtgcagctggtgcagtctgggggctgaggtgaggaagccgtgggggcctcagtgaggtctctgcaaggcttctggctacaccttcaccggcgactatctccactggggtgcgacaggcccctggacaagggcttgagtggagtgggatggatacaaccctaacaatggtaggcacaaactangacacagagtttcgagggcgagggtcacatcgacgaggacacgtccatcacgcacgagaccctanagtggagacgtgacgcgagactagactagtctacggacgacgaccggtctaaactttacttacgtcgtacgacggtaaggtaacgttcggtttaaccggtggtcgtttacgggttttccttttaacgggg

SEQ ID NO: 349269 - DNA, 582 bp, Homo sapiens
  misc_feature: GZ8MTXP02ILXGT.45.37.D04.1.454.CMB.2.raw
  modified_base (477)..(477): a, c, t, g, unknown or other
  misc_feature (477)..(477): n is a, c, g, or t
  modified_base (493)..(493): a, c, t, g, unknown or other
  misc_feature (493)..(493): n is a, c, g, or t
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagcccactccccaggtgcagctggtgcagtctggggctgaggtgaggagccgtggggcctcagtgaaggtctcctgcaaggcttctggctacaccttcaccggcgactatcctccacgtgggtgcgacacggcccccgtggacaaggggcttggagtgggagtgggagtggataccaaacccctaaccgaaagtggtacggacaactaaaactatcgacaacaagtaaacgtttcgaagggacacggggtcaaccagtacgaccgagggaccacggtccaatcaacgcacacgcctaacgagtgggactcgngacgactagactgacntcgacgacaccgacgacctaatttacttacgtgtacgaggtaacgtagtttacgggtttacggtgttcgttacggttttctttaacggg

SEQ ID NO: 349270 - DNA, 617 bp, Homo sapiens
  misc_feature: GZ8MTXP02G3EGP.45.37.D04.1.454.CMB.2.raw
  modified_base (344)..(344): a, c, t, g, unknown or other
  misc_feature (344)..(344): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatctccactgggtgcgacacggcccctggacaagggcttgagtggagtgggatggatcaaaccccctaanaacgtggtaggcaacaaactatgacaacgaagtaaagttttcgaaggggtcgacggggttaccaacccgagtacggaaaccgaggggaacaccggtaccaatcgacgacaacgacgacctaacagtgggaagctaggacgacgaaggactacggaactactacgtacggaaccggaaccgaaccgggacccttaaattttacttaaccgtggttagaaccggtaaggtacgtttacggtttaccgggtcggtcgtttacgggtttttacccgg

SEQ ID NO: 349271 - DNA, 498 bp, Homo sapiens
  misc_feature: GZ8MTXP02JQMVK.45.37.D04.1.454.CMB.2.raw
  modified_base (341)..(341): a, c, t, g, unknown or other
  misc_feature (341)..(341): n is a, c, g, or t
  modified_base (415)..(415): a, c, t, g, unknown or other
  misc_feature (415)..(415): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatgggatggatccaaccctaanatggtggcacactatgcacagaagtttcagggcagggtacacatcgacgaggacacgtcatcagcacagcctanatggagctagagcgagactgacatcgtgacgacacggcctagtttactactgtgcgaggtactgtttaccggtgtcgtttcgg

SEQ ID NO: 349272 - DNA, 682 bp, Homo sapiens
  misc_feature: GZ8MTXP02HB63I.45.37.D04.1.454.CMB.2.raw
  modified_base (255)..(255): a, c, t, g, unknown or other
  misc_feature (255)..(255): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggacgccgtgggcctgagtgaggtctcctgcgaggtcttcgnggactacaccttcaccggcgactacgtcctccagtggtcgaccgacgaccggccccgtaggaacgaagggtcttaggaggtaggagtgggagttaggactaccaaaacccccgtaagaagtggtacgactaacctaaacgtgtacgacaacgtaagtaacgtttcgacgggtacgtacgggcctaaaccgagtaccgaacggtaacggggactacccggtacaacgaccgacgaaccacgaaccggaccttacgaaggtacggacgtaccgtaggaccgaccgaacgggtaacttacggacttaacgtaccgtaacggaaacccggacgtaaccggtaactttaacgtttacgttacgtaggtacggtaacggtaaggttaccgtttacgggtttaccggtcggttccggtttacggtttttcccgg

SEQ ID NO: 349273 - DNA, 591 bp, Homo sapiens
  misc_feature: GZ8MTXP02GKTFY.45.37.D04.1.454.CMB.2.raw
  modified_base (365)..(365): a, c, t, g, unknown or other
  misc_feature (365)..(365): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactcccaggtgcagctggtgcagtctgggggctgaggtgaggaagcctggggcctcagtgaaggtctcctgcaaggcttctggctacaccttcaccggcgactatctccactgggtgcgacacggcccctggacaagggcttgaggtggatgggatggatcaaaccccctaacaatgggtacgcaacaaactntgcacagtaagtttcgagggcaaggggtcaacccgatacggaaccgaaggggtaacaccggtacccagtccgagacctacacgacctaacagtgggaacgtcctagacgacaacggactggaacactccgtaggaccgacgaacgggccctaagtttacttaaccgtgtaggaaccggaaggtacttcgggtttacccggtaggtccgtttcggggtttttacccg

SEQ ID NO: 349274 - DNA, 584 bp, Homo sapiens
  misc_feature: GZ8MTXP02IN9A3.45.37.D04.1.454.CMB.2.raw
  modified_base (342)..(342): a, c, t, g, unknown or other
  misc_feature (342)..(342): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacacggcccctggacaagggcttgagtggatgggatggatccaaccctaanagtggtgacaacaactatgcaacagtaagtttcgagggcagggtcaccgatcgaaccgagggaccacgtccaatcagacacacgacctacagtgggaacgcgtagacgacaacggtacctaggacaacgtacgtacggaaaccgaccgaaccgggtacctaagttttaaacttaccgttaggttaacgaccggtaaggttacgtttcgggttttaacccgggttgggtacctttttccgggg

SEQ ID NO: 349275 - DNA, 643 bp, Homo sapiens
  misc_feature: GZ8MTXP02GYB4I.45.37.D04.1.454.CMB.2.raw
  modified_base (348)..(348): a, c, t, g, unknown or other
  misc_feature (348)..(348): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtgggcctgagtgaggtctcctgcaggcttcgtggctacaccttcaccggcgactatcctccacgtgggtgcgacacggcccctggacaagggtctggagtggagtgggatggactacaaaccccctaanaagtggtacggacaacaaactagtcgactaaacgtaagtaaacgtttacggaggggtaccgtaacggggtacccaaacccgtaagtaccgaacccggaaacggggaaaccctacccggtaaccaacgtaccaacggaccaacgaccgacccttaacgagtacgggaacgtccgaggacgacgaagtactacgacgtactcgtacgaacgaccgaccggtaccttaatttacgtaccgtgtacgaacggtacggttacgtttacggttaccggtcggtccgtttacggttttaccg

SEQ ID NO: 349276 - DNA, 645 bp, Homo sapiens
  misc_feature: GZ8MTXP02INB6T.45.37.D04.1.454.CMB.2.raw
  modified_base (294)..(294): a, c, t, g, unknown or other
  misc_feature (294)..(294): n is a, c, g, or t
  modified_base (545)..(545): a, c, t, g, unknown or other
  misc_feature (545)..(545): n is a, c, g, or t
  modified_base (551)..(551): a, c, t, g, unknown or other
  misc_feature (551)..(551): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagcctggggcctcgagtgaaggtctccgtgcaggcttcgtggctacaccttcgaccggcgactactctccacgtgggtcncgacgacggccccgtggacgaagggtctggagtggagtgggatggactaccgaaaccccctaacgaagtggtacggtacaaactaaactgtacgacaaacgaagttaaagtttacgaaggggtaccgaaggggtaccaaccgtaagtaccggaaacccgaaggggaccctaccggttaccaacgtacccgaagacccgaaacaccggtaccctacgtaagtcgggaacgcgaggacgaccgaaagcgttanaaccgnttaccgagaacccgacgtaaccggtaccttatttacgtactggagtcgaggttacgttaccggtttcgggtccgttacggtttcgttttaccgg

SEQ ID NO: 349277 - DNA, 541 bp, Homo sapiens
  misc_feature: GZ8MTXP02HLXFN.45.37.D04.1.454.CMB.2.raw
  modified_base (224)..(224): a, c, t, g, unknown or other
  misc_feature (224)..(224): n is a, c, g, or t
  modified_base (404)..(404): a, c, t, g, unknown or other
  misc_feature (404)..(404): n is a, c, g, or t
  modified_base (425)..(425): a, c, t, g, unknown or other
  misc_feature (425)..(425): n is a, c, g, or t
  modified_base (442)..(442): a, c, t, g, unknown or other
  misc_feature (442)..(442): n is a, c, g, or t
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
  modified_base (462)..(462): a, c, t, g, unknown or other
  misc_feature (462)..(462): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagctggggcctnagtgaaggtctcctgcaaggcttctggctacaccttcaccggcgactatcttccactgggtgcgacacggcccctggacaaggggcttgaggtggatgggatgggatccaaccccctaaacaagtggtaggcaacgaaaactattgacaaccagaagtttcagggtcaaggggtcaccanacgaccagggacacgtccaancagcaacagacctacanggagcganacgganacgacngacatcgtacgacgacgacgacttacttactacgtgtacgaacgtagtacgttacggtacggtcggtcgtttcgtttcg

SEQ ID NO: 349278 - DNA, 527 bp, Homo sapiens
  misc_feature: GZ8MTXP02JX7R7.45.37.D04.1.454.CMB.2.raw
  modified_base (345)..(345): a, c, t, g, unknown or other
  misc_feature (345)..(345): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacaccttcaccggcgactatctccactgggtgcgacacggccctggacaagggcttgagtggatggggatggactaccgaacccctaanaacgtggtacggcaacactatagacacgagaagtttcgagggcagggtcacatcgaccgaggaccacgtcatcagacacagacctacacgtggacgctgagcacggactgacattacgcgacgcgaacggcctaatttactactgtgacgaggtagttacggtttccggtggtcttttcggg

SEQ ID NO: 349279 - DNA, 690 bp, Homo sapiens
  misc_feature: GZ8MTXP02GGBAP.45.37.D04.1.454.CMB.2.raw
  modified_base (342)..(342): a, c, t, g, unknown or other
  misc_feature (342)..(342): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcgaccggcgactatctccacgtgggtgcgacgacggcccctggacaaggcttgagtggagtggatggatcaacccctaanaatggtaggacaacaaaactatcgacaacgaagtaagtttacgaaaggggcaacggggtaccaacccgaagtacgaacccgaaaggggaccaaccggtaccaactaccaacggaccaaaccgacgacccttaaaccgaagttacggggaaacgccgtaggaacggacgaacggaaccgtacggaaaccgtacttaccgtacggaaacccgaaaccgaaacccgggtaacccttaaacgtttttaatttaaacccgttggtttacggaaccggtaaaaggggttaacgtttaacggggtttttaaccccgggggttaggttccccggttttaggggttttttaccccgg

SEQ ID NO: 349280 - DNA, 508 bp, Homo sapiens
  misc_feature: GZ8MTXP02GPX9X.45.37.D04.1.454.CMB.2.raw
  modified_base (240)..(240): a, c, t, g, unknown or other
  misc_feature (240)..(240): n is a, c, g, or t
  modified_base (314)..(314): a, c, t, g, unknown or other
  misc_feature (314)..(314): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
  modified_base (409)..(409): a, c, t, g, unknown or other
  misc_feature (409)..(409): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacngaactccaaacaataagaactacttagcttggtaccagcagaaaccaggtcagcctctaagctgctcatttacnggcatcgtaccggatccggggtcccctgaccgattcagtgcngcggtctgggacngtatttcactctcaccatcagcagcctgcagctagaaagntgtggctagtttattgctgtcagactaattatattatacttcctcgtactttcggcctcggaaccaagttggaatactacaaacgtactgtacgctacg

SEQ ID NO: 349281 - DNA, 699 bp, Homo sapiens
  misc_feature: GZ8MTXP02FSHO2.45.37.D04.1.454.CMB.2.raw
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctcctgcaaggcttcgtggctacacccttcaccggcgactatctccacgtgggtgcgacgacggccccctaggacgaaggggcttggaggtgggagtggggatggaactaccgaaaacccctaacgaagtggtacggactaacaaaaccttagtcgacaacgaaggtaacgtttcgaaggggacacggggtaccaaccgtaagtacggaaccgaaggggaccaccggtcctaataccgaacggaccaccgtaacgacccttaacgaagttgggagtaccgtagaacgaccgaacggaaccttaggaaacctaacgtccggtacggaaccgaacccggtaccgggtaaccctttaaagttttacgtttaaccgtgggttacgaccggggtaaggttacggtttacgggttttaacccggggttggttaccggttttcggggttttaccccgttttttaacgggg

SEQ ID NO: 349282 - DNA, 575 bp, Homo sapiens
  misc_feature: GZ8MTXP02H3GEM.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttctggctacaccttcaccggcgactatcctccactgggtgcgacacggcccctggacgaagggcttgagtggagtgggatggataccaaccccctaacaagtgggtacggacaacaaactgtgacaacgagtaagtttcgagggtcgacgggtcacagtcgaccgaggacacgcatacagcacgacgacctaacgagtggacgtcgagacgacagacgtagacatcgtacgaccgaacgaccggtacctaaagttttacttacgtaggtcgtaacggtaggtacgtttcggtttaacggtcggttcgtttacggtttttacccgg

SEQ ID NO: 349283 - DNA, 584 bp, Homo sapiens
  misc_feature: GZ8MTXP02GUNEK.45.37.D04.1.454.CMB.2.raw
  modified_base (344)..(344): a, c, t, g, unknown or other
  misc_feature (344)..(344): n is a, c, g, or t
  modified_base (365)..(365): a, c, t, g, unknown or other
  misc_feature (365)..(365): n is a, c, g, or t
  modified_base (450)..(450): a, c, t, g, unknown or other
  misc_feature (450)..(450): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggagccgtggggcctcagtgaggtctctgcaaggctctggctacaccttcaccgggcgactatcctccacgtgggtgcgacgacggcccctggacaagggcttggagtggatgggatggatcaaacccctaanagtggtaggacaacaaaactntagacacaagtaagtttcgaaggggtcgaggggtcaaccgagtacgaacccgagggaccacgtaccatcagaccacacgacctanacgtggaacgcgtagagacagtacgagaactagtctacggaccgacaaccggacccttaagtttactaccgtgttacggaacggtaggtacgttcgggtttaccggtcggttccggtttacgggtttttacccg

SEQ ID NO: 349284 - DNA, 608 bp, Homo sapiens
  misc_feature: GZ8MTXP02F2AX3.45.37.D04.1.454.CMB.2.raw
  modified_base (258)..(258): a, c, t, g, unknown or other
  misc_feature (258)..(258): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctctgcagcttcgtggctacncttcaccggcgactatctccactggtgcgacacggcccctggacgaaggcttggagtggagtggggatggactaccaacccccgtaactaagtgggtacggactaaccgtaaaactgtacggactaaccgtaagtaacgtttacgaaggggtcgacggggttaccaacgtagacgaaccgacggggaacaccggtacaacgtcacgacaacgacgtaccctaagagtaggaacgtcgacggacgacgagacgtgaacacgtactacggacgacaccggtacttaactttacgtacgtgtacgcgtaggttacttacgggtttacggtcggtaccgtttggtttttaccgg

SEQ ID NO: 349285 - DNA, 582 bp, Homo sapiens
  misc_feature: GZ8MTXP02GJ1U2.45.37.D04.1.454.CMB.2.raw
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (437)..(437): a, c, t, g, unknown or other
  misc_feature (437)..(437): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctaccaacaataagaactactagcttaggtaccagcaagaaaccaggtcagcctactaagctgctctatttacgtgggctatccgtaacccgggacgtcccggggtcccctgacctattcgaggtggcngggcggtcnggggactagtatttcgactctcacctatcagccagccctgctaggactagaagagtgngggtcctagtttagttcgcgttgtcaagactaaattaatttattaaacttctttacccgtaccgttaccgtttaccggacccgtttacgggaaccctaaaggtacggtaatactaacgtaaaaccgtagtacggtacggttcacg

SEQ ID NO: 349286 - DNA, 576 bp, Homo sapiens
  misc_feature: GZ8MTXP02I9YBZ.45.37.D04.1.454.CMB.2.raw
  modified_base (370)..(370): a, c, t, g, unknown or other
  misc_feature (370)..(370): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaggcttctggctacaccttcaccggcgactatcctccacgtggtgcgacgacggcccctggacgaagggcttgagtggagtgggatggataccaacccctaacaacgtggtacggacaacgaaactntacgacacaagtaagtttacgaggggcgacgggtacaccagtcgacgaggacacgtcatcagcacacgaccacgagtacggagcgtgagacagactgactactcgacgacgaacgacggaccttaacgttttacgttaacgtcgttaggaacggtaggttacgtttacgggtttaccggttcggtacgtttcggttttttacccgg

SEQ ID NO: 349287 - DNA, 676 bp, Homo sapiens
  misc_feature: GZ8MTXP02GZEYO.45.37.D04.1.454.CMB.2.raw
  modified_base (393)..(393): a, c, t, g, unknown or other
  misc_feature (393)..(393): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgaggagggccaccatcaactgacaacgtccagccagtagttgtttagacagcctacaaacaataagaactacttagcttacggtaccagacaagaaccagtcacgtctaccgtaagctgctctatttacgtcggctacgtaccgtacccggggaacgttcccggggtccccctacgaccgtatcgaggtcggcgngggtcgggtcgaggactagtacttccacgtcctaccaacctataccgacgccgacgcccgtggaccgtagggactaaggaaagtgttacgggtcggttacgttaagtttgtcgtcgttcggtaaccaggtaacttaagtttaatttaactttaacgttaccgttacccgtttaccggttacccgttttacccgggaaccccgttaacgggggtaaaccctaaagggtttcgaaacttaacgtaaaccgtaaaaaccggtacgttggtaccggtaccgtaaccg

SEQ ID NO: 349288 - DNA, 666 bp, Homo sapiens
  misc_feature: GZ8MTXP02ISR74.45.37.D04.1.454.CMB.2.raw
  modified_base (364)..(364): a, c, t, g, unknown or other
  misc_feature (364)..(364): n is a, c, g, or t
  modified_base (381)..(381): a, c, t, g, unknown or other
  misc_feature (381)..(381): n is a, c, g, or t
tcagacgcgatcgacacgaccggtgctcgatttagtagcatactgttgggtttgggggagctacaacaggcaggcaggggcagcaagatggtgttgcagaccccaggtcttcatttctctgttgctctggatctctggtgcctacggggacatcgtgatgacccagtctccagactccctggctgtgtctctgggcgagagggccaccatcaactgcaagtccagccagagtgttttagacagctccaaacaataagaactactagcttggtaccagcagaaaccaggtcagcctacctagctgctcatttactggctatccgtacccggaagtcccgggtccccctgaccgtatcaggtgcgnggcgggtcgtggggacngtatttccactctccacagtcaagcagcccgtgacgaaggtccgtagaaaagtgttcggtacgggtaccttaggttttaagttggtaacccgttggttaccgaaggtaccttaaaagtttaatttagttttaaaccgttaacttttcccccgttacccggtttaacccgtttttacccggggacccccgtttaacgggggaaaacccccgttaaaaggtacgggttaaacttaaacgttaacccgaaaaacggtaaacccgttggttaccgggtacttaacccgg

SEQ ID NO: 349289 - DNA, 557 bp, Homo sapiens
  misc_feature: GZ8MTXP02I40F1.45.37.D04.1.454.CMB.2.raw
  modified_base (357)..(357): a, c, t, g, unknown or other
  misc_feature (357)..(357): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatctccactgggtgcgacacggcccctggacaaggggcttgagtggatgggatggatcaaccccctaacagtgtagcacaactntgacacagaagtttcgagggtcagggtcaccgatagaccgagggacacggtacatcagcacgacgcctacagtgagcgtagagcagacagacaatctagaccgacacggtaccctaattttacgttaaccgtaggttcgaaccgggtaaggtacgtttacggtttaacccgggtggttccggtttacggttttttcccgg

SEQ ID NO: 349290 - DNA, 558 bp, Homo sapiens
  misc_feature: GZ8MTXP02HNM8O.45.37.D04.1.454.CMB.2.raw
  modified_base (249)..(249): a, c, t, g, unknown or other
  misc_feature (249)..(249): n is a, c, g, or t
  modified_base (366)..(366): a, c, t, g, unknown or other
  misc_feature (366)..(366): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggagcctgggcctcagtgaggtctcctgcaaggcttcnggctacacccgtttcgaccgggtcgtacctatccgtccacgtgggtcgcgacacggcccctggacaggtcttgagtggagtgggatggactcaacccctagagtggtagcacaactntcgacacgagtagtttcagggcaggtcacgagtcgacaggacacgtcagtcgacgacacgacgtccgtaacgagtggacgtcgtacgacgacgacgtacgtgactagtcgtacgacgtacacggtactacgttacgtacgtacgtagaacgtaggtacgttcggttacggcggttacgttacggttttaccg

SEQ ID NO: 349291 - DNA, 614 bp, Homo sapiens
  misc_feature: GZ8MTXP02G0GFD.45.37.D04.1.454.CMB.2.raw
  modified_base (254)..(254): a, c, t, g, unknown or other
  misc_feature (254)..(254): n is a, c, g, or t
  modified_base (456)..(456): a, c, t, g, unknown or other
  misc_feature (456)..(456): n is a, c, g, or t
  modified_base (464)..(464): a, c, t, g, unknown or other
  misc_feature (464)..(464): n is a, c, g, or t
tcagacgcgatcgacacgaccggtgctcgatttagtagcatactgttgggtttgggggcatcaccccagcaaccacatctgtcctctagagaatccccctgagagctccgttcctcaccatggactggacctggaggatcctcttcttggtggcagcagccacaagagcccactccccaggtgcagctggtgcagtctgggggctgaggtgaggaagccgtggggcctcagtgaaggtctcctgcaaggcttcnggctacaccttcaccggcgactatctccacgtgggtgcgacacgggccccctggacaagggcttgagtggatggggatgggataccgaaaccctaacaagttggtagacaacaaaccgtatcgacaacagtaagtttcgagggacgagggtaccacgagtacgaccgagggacccacgtaccagtcgaagcacacgccctanacgtggancgtgacgacgagactgaactagtccgaggtaaccgacgaaccggtcccttaaattttaacgtaccgttaggtacggtaccggtaaggtacggtttaccgggttttaccggggtcggttccgtttacggggttttccgtttttaaccgggg

SEQ ID NO: 349292 - DNA, 579 bp, Homo sapiens
  misc_feature: GZ8MTXP02IWXN0.45.37.D04.1.454.CMB.2.raw
  modified_base (279)..(279): a, c, t, g, unknown or other
  misc_feature (279)..(279): n is a, c, g, or t
  modified_base (293)..(293): a, c, t, g, unknown or other
  misc_feature (293)..(293): n is a, c, g, or t
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
  modified_base (472)..(472): a, c, t, g, unknown or other
  misc_feature (472)..(472): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctgagtgaaggtctcctgcaaggcttcgtggctacaccttcaccggcactancctccacgtgggcncgacacggcccctggacagggcttgagtggagtggatggactaccccgaaaccctaanaagtggtggaccaaacgaactntacgacacgtaagtaacgtttcgagggccgaggggtacaccgaagtacgaccgaagggtaccacgtaccagtaccgaacgaccaacgacgacccctaanacgtgggaacgcgtagagcgtaaggactagactaagtcgagaacgacacggaccttagtttactacgtgtgcgaaggtacgtttggttaccggtgtttcgtttacgg

SEQ ID NO: 349293 - DNA, 630 bp, Homo sapiens
  misc_feature: GZ8MTXP02JK1LU.45.37.D04.1.454.CMB.2.raw
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctgaggtgaggagccgtgggcctcagtgaggtctcctgcaggcttcgnggctacnccttcgaccggcgactatcctccgacgtgggtgcgacgaccggtcccccgtaggaaccgaagggcttggaggtggagtgggatggaatccaaaccccctaagaagtggtacggacaaactaaactgtcgactaaacgagtaacgtttcgaaggggctaacggggtacaaccgtatacgaccgagggaccaccgtaccaagtacgacgcaacgacgtacctaacgagttacgggactacgagacgacgaacggtacacggtacctagtccgtaggaaccgaccgaccggtaaccttaagttttacgtacgttcggtagtaacggtaaggttacgtttacgggtttaccggcggtttccgtttcggtttttaccgg

SEQ ID NO: 349294 - DNA, 642 bp, Homo sapiens
  misc_feature: GZ8MTXP02JJWNH.45.37.D04.1.454.CMB.2.raw
  modified_base (258)..(258): a, c, t, g, unknown or other
  misc_feature (258)..(258): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggctcagtgaaggtctcctgcaaggcttctggctacnccttcgaccggcgactatcctccgacgtgggtgcgacgacggccccctggaccgaaggggtcttaggaggtggagtggggatggaactaccaaacccccgtaacgaagttcgggacggacaaaccaaactcgtcgacaaacgaagtaagtttcgaaggggccgaggggtaccaaccggtagtacgaaccgaaggggaccaccggtcaagtcacgacaacacgacctacgaagtggacgaccgtagacgacgacgtacgtaggaacctaggttccacggaaccgacgacccgggtacttaacgtttacgttaccgttaggtaccggtaagttccgttacgggtttaacggtcggttaccgtttacgggtttccgttttaaacggg

SEQ ID NO: 349295 - DNA, 551 bp, Homo sapiens
  misc_feature: GZ8MTXP02F75QF.45.37.D04.1.454.CMB.2.raw
  modified_base (351)..(351): a, c, t, g, unknown or other
  misc_feature (351)..(351): n is a, c, g, or t
  modified_base (403)..(403): a, c, t, g, unknown or other
  misc_feature (403)..(403): n is a, c, g, or t
  modified_base (418)..(418): a, c, t, g, unknown or other
  misc_feature (418)..(418): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctctgcaaggcttctggctacaccttcgaccggcgactactcctccacgtggtgcgacgacggccccgtggacgagggcttgagtggagtggatggataccaaacccctaanagtggagacaacgaaactgcgacaacagtaagttcgagggcgaggtcacgangacgagacacgtcancagcacacgacctaacagtcgggagcgtagacgacgacgaactgaacactcgacgaacgaccgaccggtactagtttacgtaccgtgtacgaacgtaggtacgttcggttacggtcggtcgtttcggttttcg

SEQ ID NO: 349296 - DNA, 604 bp, Homo sapiens
  misc_feature: GZ8MTXP02G3JYA.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcagtgaaggtctcctgcaaggcttctggctacaccttcaccggcgactatcctccactgggtcgcgacgacggccccctggaccgaagggcttggaggtggagtgggatggatacaaccccctaacaagtggtcggacaacgaaactgtcgacaactagtaagtttcgaagggccgagggggtccaaccgatcgaccgaagggacaccgtccatacgacgcaaccacgacctaacgagtagggagtccgtagacgcgaacggtacacggaactagtcccgtagaaccggaccgaccggtaccttaagtttaacgtaccgtaggtacggtaacggtaaggtagtttacggttaccggtggtcgtttacggtttttcccgg

SEQ ID NO: 349297 - DNA, 608 bp, Homo sapiens
  misc_feature: GZ8MTXP02IAVRP.45.37.D04.1.454.CMB.2.raw
  modified_base (478)..(478): a, c, t, g, unknown or other
  misc_feature (478)..(478): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctgaggtgaggaagccgtggggcctcgagtgaaggtctcctgcaaggtcttcgtggctacaccttcaccggcgactatctccacgtgggtgccgacgacggcccctaggaacgagggtcttggaggtggagtgggatggactacaaacccctaagaagtggtaggacaacaaactatcgacaacgtaacgtaagtttcgagggtcgacgggtaccaacgagtacgaacccgagggaacctaccggtaccaagtaccgacgacaaacgacgaccctanagtaggacgcgtagacgacgaagctagactagtcgtacgacgacgaccggtaccttaagtttacgtacgttcgtggtaacggtagtacgtttcggtttaccggtcggttcgttttacggtttttacccgg

SEQ ID NO: 349298 - DNA, 663 bp, Homo sapiens
  misc_feature: GZ8MTXP02H9ASR.45.37.D04.1.454.CMB.2.raw
  modified_base (227)..(227): a, c, t, g, unknown or other
  misc_feature (227)..(227): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagcgtggggcctnagtgaggtctcctgcaaggcttctggctcaccttcaccggcgactactctccacgtggggtgccgaacgacggcccctgggaacgaggggtcttggaggtggagtgggagtggactcgaaaccccctaagaagtggtaggacaaacgaaacctagtacggacaacgaagtaaacggtttacggaaggtaccgaacggggtacaaacccgtagtacggaaacccgacggggtaaccaccggtacccaagtaccgacgaccaacgtaccggaccctaacgaacgttcgggaacgtcgttaacggacgacgaacgacgttacgaactacgtactacggaaccgaccgaaccggtacttaaacgtttacttaaccgtggtacgaaccggtaaggtacgtttacggtttaccggttcggtcgttttacgggttttacccgg

SEQ ID NO: 349299 - DNA, 602 bp, Homo sapiens
  misc_feature: GZ8MTXP02IERPQ.45.37.D04.1.454.CMB.2.raw
  modified_base (387)..(387): a, c, t, g, unknown or other
  misc_feature (387)..(387): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctgggctgaggtgaggagcgtggggcctcgagtgaggtctctgcagtcttcgtggctacaccttcgaccggcgtacctactcctccacgtgggtgccgacgacggccccgtaggaaccgaagggtcgttaggacgggtggagtggggatgggaactaccaaccccctaaacagtggtcggacaaacaaacttntcgacaactagtacgttcggaggcgacgggtcacgagtacgaccgaggacacgtacatcgacgacacacgtaccaacgtagaggagtcgagacgcgaagacgtagactagtcgtacggaaccgacgtaccgtaccttaacgtttactacggttagtacggaacggttaacggtacgtttacggtttacgggtacgttcggtttacggttttccgg

SEQ ID NO: 349300 - DNA, 727 bp, Homo sapiens
  misc_feature: GZ8MTXP02F969S.45.37.D04.1.454.CMB.2.raw
  modified_base (192)..(192): a, c, t, g, unknown or other
  misc_feature (192)..(192): n is a, c, g, or t
  modified_base (321)..(321): a, c, t, g, unknown or other
  misc_feature (321)..(321): n is a, c, g, or t
  modified_base (490)..(490): a, c, t, g, unknown or other
  misc_feature (490)..(490): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgngggcgaggacggccacatacaacgtgacaacgtccacgacctaggtagtttggtttaagactacgcctaaccaaaactaagtaaactaaccttacttagcgtttacggaaccagacgaaacgaaaccgnggtacacgtcctaccgtaacgctcgacttacgttaactttcggcggacttacgtacccgtaacccgggtaacttccggtacccggtaccctacgaccgtactttcgacggttcgacgtcgggtccgggttgtacgggactaagttactttccaccttctacccaactanacgaacgccgtaccgtctcgacgtagtacgaaaggtacgtaggttcggtacgttactttaggtttactcggtacgttacgaacgtaagttaactttaaatttactttaacggtttactttacccgtttccccggttaaccggtttaccggttaccccggaaccggtaaacgggtaaaccgttaaaggtcgttaaaacttaaccggtaaaccgaaacggttacggttcggtaccgtac

SEQ ID NO: 349301 - DNA, 641 bp, Homo sapiens
  misc_feature: GZ8MTXP02I2LMC.45.37.D04.1.454.CMB.2.raw
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaggtctctgcaggcttcgnggctacnccttcgaccggcactatctccacgtgggtgcgacgacggcccctggaacgagggtctggagtggagtgggatggaactaccaaaccccgtaacaagtcggtaggacaaacaaactgtgacaacgagtaagttcgagggcgagggtaccacgagtacgaccgagggaccacgtaccatcacgcaacacgacctaacgagtgggaactcgtagacgacgaacggtactaggaacctagtaccgtacggaaaccggaacccgtaaccgggtaccttaaacgtttttaaccgtacggttacggtacggtaaccggtaaaggttacggttttaaccgggggttttaccgggtcggggtttaccgttttcggggtttttttaccccgg

SEQ ID NO: 349302 - DNA, 540 bp, Homo sapiens
  misc_feature: GZ8MTXP02GUI4N.45.37.D04.1.454.CMB.2.raw
  modified_base (367)..(367): a, c, t, g, unknown or other
  misc_feature (367)..(367): n is a, c, g, or t
  modified_base (464)..(464): a, c, t, g, unknown or other
  misc_feature (464)..(464): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggggctggaggtgaggaagccgtggggcctcagtgaaggtctcctgcaaggcttctggctacaccttcaccggcgactatctccactgggtgcgacacggcccctggacaagggcttgagtggagtgggatggatcgaaccccctaacaagtggtggcaacgaaactntgacacagtaagtttcgagggcgagggtcaccatgaccgagggacacgtacatcacgcacacgacctacagtggacgctgagcgagtacagacatcncgacgactaccggacctatttacttactggtagcggtaggtattcggtttaccggtggtcgttcggtttttaccgg

SEQ ID NO: 349303 - DNA, 574 bp, Homo sapiens
  misc_feature: GZ8MTXP02HERZV.45.37.D04.1.454.CMB.2.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (356)..(356): a, c, t, g, unknown or other
  misc_feature (356)..(356): n is a, c, g, or t
  modified_base (379)..(379): a, c, t, g, unknown or other
  misc_feature (379)..(379): n is a, c, g, or t
  modified_base (477)..(477): a, c, t, g, unknown or other
  misc_feature (477)..(477): n is a, c, g, or t
  modified_base (541)..(541): a, c, t, g, unknown or other
  misc_feature (541)..(541): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggagccgtgggcctnagtgaaggtctcctgcaaggcttnggctacaccttcgaccggcgactatctccacgtgggtgcgacacggccccgtaggacgaagggtcttggaggtggagtggggatggactaccccgaaaccctanaacgtgggtacgacgaacaactntagaccaacgagtaagtttacgaggggacacgggtaccaaccgagtacggaaccgacggggaccacggtccatcaagccacgagcctacagtacggancgtagacgacgacgactagaactacgtacgacgacgaccgaacggtcctaatttactacgtagngacgaagtcgttcggttacggtgtacgtttcgg

SEQ ID NO: 349304 - DNA, 600 bp, Homo sapiens
  misc_feature: GZ8MTXP02I4DYI.45.37.D04.1.454.CMB.2.raw
  modified_base (226)..(226): a, c, t, g, unknown or other
  misc_feature (226)..(226): n is a, c, g, or t
  modified_base (373)..(373): a, c, t, g, unknown or other
  misc_feature (373)..(373): n is a, c, g, or t
  modified_base (460)..(460): a, c, t, g, unknown or other
  misc_feature (460)..(460): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctnagtgaaggtctcctgcaggcttctggctacaccttcaccggcgactatcctccactgggtcgcgacgacggccccctggaacgaagggcttggaggtggagtgggatggatccaaaccccgtaacaatgggtacggacaacaaactntgacacagaagtttcgaaggggccaggggtcaaccgagtacgaccgagggacaccgtacatacagcacagccctaacagtacgggancgtagacgacaagacctaggacctatccgtacgaacgaccgaccggtacctaaaggttttactaaccgttggttacgaacgggtaacggttacgtttacgggttttaaccgggtcggtacgtttcgggttttttacccgg

SEQ ID NO: 349305 - DNA, 529 bp, Homo sapiens
  misc_feature: GZ8MTXP02GRFKI.45.37.D04.1.454.CMB.2.raw
  modified_base (341)..(341): a, c, t, g, unknown or other
  misc_feature (341)..(341): n is a, c, g, or t
  modified_base (434)..(434): a, c, t, g, unknown or other
  misc_feature (434)..(434): n is a, c, g, or t
  modified_base (446)..(446): a, c, t, g, unknown or other
  misc_feature (446)..(446): n is a, c, g, or t
  modified_base (459)..(459): a, c, t, g, unknown or other
  misc_feature (459)..(459): n is a, c, g, or t
  modified_base (509)..(509): a, c, t, g, unknown or other
  misc_feature (509)..(509): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaacggcccggggctcgagtgaaggtctcctgcaaggcttctggctacacccttcaccggcgactatctccacgtgggtgcgacaggccccctggacaaggcttgagtggatgggatggatcaacctanaagtggtgacaacaaactatgcaacaggtaacgtttcgaaggggcaggggtaccacgatgaccgagggaccacgtccatcagcacagccctanatggatcagacnagactgacatcgngacgacgacggccttattactacgtgtgcgaaggtcttacggttaccggngtcgttcggtttctttacgg

SEQ ID NO: 349306 - DNA, 610 bp, Homo sapiens
  misc_feature: GZ8MTXP02IJ5FK.45.37.D04.1.454.CMB.2.raw
  modified_base (352)..(352): a, c, t, g, unknown or other
  misc_feature (352)..(352): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctcctgcaaggcttctggctacaccttcaccggcgactatcctccacgtgggtgcgacacggcccctggaccgaaggggtcttggagtggatgggatggactcaaccccctaanatggtaggacaacaaactagtcgacaacgagtaagtttcgagggcagggtcaccgatacgacagggacacgtcatcacgcacacgacctacgacgtgggacgcgtacggagaccgaggaaccttacggaactacgttaccgtacggaacccgaaaccgaccgggtaacccttaagttttaacttacgtaggttacggaaccggtaggtacgttttcggttaaccgggttcggtttaccggtttcggttttttacccgg

SEQ ID NO: 349307 - DNA, 623 bp, Homo sapiens
  misc_feature: GZ8MTXP02GBEFZ.45.37.D04.1.454.CMB.2.raw
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatcctccacgtgggtgcgacacggcccctaggacaagggcttggagtgggagtggtagtagactaacctaacctaacgtagtggtacgacaaactaacttagcgacaacgaagttaacgttggacgggacggtacgtacccaaactacggtaccgaacggacggaacccgtaccgtaccacgacgacaccgacgaaccgaccctaagtacggtaggaccgtaggagacgacgaacgtacgacacgtactacgtacgaacgaccgacgtacttaaatttaccgttacgtgtacggacggtaagttacgtttacgggttacggttgttaccggtttcgttttacgtttaccggg

SEQ ID NO: 349308 - DNA, 519 bp, Homo sapiens
  misc_feature: GZ8MTXP02F65ZK.45.37.D04.1.454.CMB.2.raw
  modified_base (362)..(362): a, c, t, g, unknown or other
  misc_feature (362)..(362): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaggtctcctgcaaggcttctggctacaccttcaccggcgactatctccactgggtgcgacacggcccctggacaagggcttggagtggagtgggatggatcaaccccctaacaagtggtaggcaacaaactntgcacagaagtttcagggcagggtcaccatacgacagggacacgtcatcagcactacgcctacatggagctagagcagactgacatcacgacgacacggtacctatttacttactgtgcgtaggtagttcggttaccggtggtcgttcggttttccg

SEQ ID NO: 349309 - DNA, 630 bp, Homo sapiens
  misc_feature: GZ8MTXP02FMVPK.45.37.D04.1.454.CMB.2.raw
  modified_base (251)..(251): a, c, t, g, unknown or other
  misc_feature (251)..(251): n is a, c, g, or t
  modified_base (376)..(376): a, c, t, g, unknown or other
  misc_feature (376)..(376): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctcctgcaggcttntggctacaccttcaccggcgactatctccacgtggtgcgacgacggccccctggacgaagggtcttggagtggagtgggatggactacaaacccccgtaacaagtgggtacggacaacgaaactntagaccagagtaagtttcgaggggcgaacggggtccaacccgagtacggaaccgaacggggaccaccggtacacgtacgacgaccaacgacggtacctaaccgagtacgggaacgtcgaggacgaccgaaggtaacctaggaaccgtacttacgtacggaaccgaaccgaccggtaccttaaattttacgttactggttaacgcggtaaggtacgtttacgggttaccggtggttcgtttccggtttttaccgg

SEQ ID NO: 349310 - DNA, 659 bp, Homo sapiens
  misc_feature: GZ8MTXP02HH8NP.45.37.D04.1.454.CMB.2.raw
  modified_base (371)..(371): a, c, t, g, unknown or other
  misc_feature (371)..(371): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccacgtgggtgcgacgacggcccctggacgaagggcttgagtggagtgggatggatacaaaccccctaaacaagtggtaggacaacgaaaactntgacaacgaagtaagtttcgaagggcgaacggggtcaaccgatacggaaccgaacggggaccaccggttacccaagtaccacgaccaacacggaccccttaagacgtagggaacgccgtaggaacgacgaacgacgtacgaacgtaactacgttacggaaacccgaaccgaccgggtaccccttaaagtttttaccttaaaccgttggttacggaaccggtaagggtacgttttacggggttttaacccgggtcgggttaccggttttcgggttttttaacccccggg

SEQ ID NO: 349311 - DNA, 637 bp, Homo sapiens
  misc_feature: GZ8MTXP02GIRHP.45.37.D04.1.454.CMB.2.raw
  modified_base (475)..(475): a, c, t, g, unknown or other
  misc_feature (475)..(475): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtggaaggtctcctgcaggcttcgtggctaccaccttcaccgggcactacgtcctaccgacgtgggtcgcgacgacggccccgtaggacgaaggtcttggagtggagtgggagtggactaccgtaaacccctaacgtaagtgggtacgtaccaaacgtaaactgtacgactaacgaacgttaagtttacgacgggggactaacggggtccaaccgtagacggacccggagggaccacggtaccancgaagtacacgacgtaccctaagacgtgggaacgtcgtagacgggacacgggtaacctaggactacgttacgaccggaacgtaccgacggtaccttaatttacttaccgtggtacgtgtaggttactttacgggttacggtcggtcgtttcggtttttaccg

SEQ ID NO: 349312 - DNA, 562 bp, Homo sapiens
  misc_feature: GZ8MTXP02JCH34.45.37.D04.1.454.CMB.2.raw
  modified_base (254)..(254): a, c, t, g, unknown or other
  misc_feature (254)..(254): n is a, c, g, or t
  modified_base (358)..(358): a, c, t, g, unknown or other
  misc_feature (358)..(358): n is a, c, g, or t
  modified_base (424)..(424): a, c, t, g, unknown or other
  misc_feature (424)..(424): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaggtctcctgcagcttctggctacncttcaccggcgactatcctccactgggtgcgacaggcccctggacaagggcttgagtggatgggatggatcaaccccctaacaacttggtcggcaacgaaactntgcaacagaagtttcgaggggcaggggtcacccagtacgaccgagggacaccgtccatcagcaacncgacctacgatgggagctagacgacacgactgacctatcgtacgacgaacgaccggtactaacgttttactaacgttcgtagtaaccggtaggtaacgtttcggttaaccggtcggtttacgttacggttttttccgg

SEQ ID NO: 349313 - DNA, 714 bp, Homo sapiens
  misc_feature: GZ8MTXP02FZ3KL.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcgagtgaaggtctcctgcaaggcttctggctacaccttcaccggcgactatcctccacgtgggtgcgacgacggcccctggacaagggcttgaggtggagtgggatggataccgaaccccctaaacgaagtggtacggaccaacgtaaaactagtgaccaacgaaagtaacggtttcgaaaggggtcgtaacgggggtaccaacccgaagtacgaacccggacggggaaccaaccgtccaacgtacacgaccaaaccgacgaccctaaccgagtacgggacgacgttacgaacggaccgaaggtaaccgtacggaaacctaacgttacccgttaacgggaaaccccgaaaccggtaacccgggtaaaccccgttaaacttttttaacgttaacccgtgggttaaccggaaccggtaaacgggttaagttttaccgggggttttaacccggggtacgggtttaccggttttccgggttttttaaccccgg

SEQ ID NO: 349314 - DNA, 624 bp, Homo sapiens
  misc_feature: GZ8MTXP02IC5DQ.45.37.D04.1.454.CMB.2.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (386)..(386): a, c, t, g, unknown or other
  misc_feature (386)..(386): n is a, c, g, or t
  modified_base (495)..(495): a, c, t, g, unknown or other
  misc_feature (495)..(495): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctctttcttggtggcagcagccacaagacgcccactcccaggtgcagctggtgcagtcgtggggctggaggtgaggagcgtgggctnagtgaaggtctcctgcaggcttcnggcacaccttcgaccggcgactactctccagtgggtgccgacgacggcccctaggaacgaagggtcttggaggtggagtgggagttaggataccaaaccccctaaagaacgtgggtacggacaaacgaaaacgtntagacaacgtaggtaacgtttcggaacggtcgaacgggtcaaaccgtagacggaaccggaggaacctacggtacccaagcaacggaccaaccgaacgaccctagtaagnggacgctagaacgaccgaagtacgagaccgatcgtacggaaccgaccgaaccgtaccttaaagttttacgtacgttaagtcgaaccggtaagtagttacggtacggtttcgtcgttttacggtttccgg

SEQ ID NO: 349315 - DNA, 539 bp, Homo sapiens
  misc_feature: GZ8MTXP02JDTHW.45.37.D04.1.454.CMB.2.raw
  modified_base (367)..(367): a, c, t, g, unknown or other
  misc_feature (367)..(367): n is a, c, g, or t
  modified_base (492)..(492): a, c, t, g, unknown or other
  misc_feature (492)..(492): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaggcttctggctacaccttcaccggcgactatcctccacgtgggtgcgacacggcccctggaccaagggcttggagtggagtgggatggataccaaccccctaacaagtggtggcaacaaactntgcacagtaagtttcgagggcagggtcaccgatgaccagggacacgtccatcgagcacagacctacagtcgggagctagagcagactgacattcacggacacgaccggtactaatttacttacgnggttgaacgtaggtacttcggttaccggtggtccgttggtttttccg

SEQ ID NO: 349316 - DNA, 547 bp, Homo sapiens
  misc_feature: GZ8MTXP02FQ8TK.45.37.D04.1.454.CMB.2.raw
  modified_base (338)..(338): a, c, t, g, unknown or other
  misc_feature (338)..(338): n is a, c, g, or t
  modified_base (354)..(354): a, c, t, g, unknown or other
  misc_feature (354)..(354): n is a, c, g, or t
  modified_base (457)..(457): a, c, t, g, unknown or other
  misc_feature (457)..(457): n is a, c, g, or t
  modified_base (500)..(500): a, c, t, g, unknown or other
  misc_feature (500)..(500): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggctggagtggatgggatggatcaacccctanaatggtgcacaaactntcgacacgagtaacgtttcgacggggtacaggggtcaaccgagtacgaccgagggacaacgtccatcagcacgacgcctacagtggacgcgtagagcagtacngacatctagacacgacggacctaatttacttaacgtgtacggngtacggtagttacggtttacccggtggtaccggtttggtttttcccg

SEQ ID NO: 349317 - DNA, 733 bp, Homo sapiens
  misc_feature: GZ8MTXP02H76G1.45.37.D04.1.454.CMB.2.raw
  modified_base (243)..(243): a, c, t, g, unknown or other
  misc_feature (243)..(243): n is a, c, g, or t
  modified_base (251)..(251): a, c, t, g, unknown or other
  misc_feature (251)..(251): n is a, c, g, or t
tcagacgcgatcgacacgaccggtgctcgatttagtagcatactgttgggtttggggagcatcacccagcaaccacatctgtcctctagagaatccccctgagagctccgttcctcaccatggactggacctggaggatcctcttcttggtggcagcagccacaagagcccactcccaggtgcagctggtgcagtctgggctgaggtgaggagctgggcctgagtgaggtctctgcaggtctntggctacnccttcaccggcgactactcctccacgtgggtgccgacgacggccccgtaggacgaacgggtcttaggaggtgggagtaggggagttcggaacttaccgaaaaccccccgtaaacgtaaaggttacggggtacggaccaaaaccgtaaaaaccgttagttaccgggaactaaacccgtaaagggttaaaccggttttaccggaaacgggggtaccgtaaaccgggggttacccaaacccgtaacggttaccgggaaaccccggaacgggggaacccgtaacccggttacccaaacgtacccgaacggaccaaaccgaccggtaacccttaaccgaggttacggggacgtaccggtaggacggactaacgggacttacggactacgttacgacggaaccgaaccgacggtacctaagttttactacgttgtacgaacggtaggtacgtttacgggttacggtcggttcgtttacggttttccgg

SEQ ID NO: 349318 - DNA, 615 bp, Homo sapiens
  misc_feature: GZ8MTXP02JWW1P.45.37.D04.1.454.CMB.2.raw
  modified_base (376)..(376): a, c, t, g, unknown or other
  misc_feature (376)..(376): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaaggtctccgtgcaaggcttctggctacaccttcaccggcgactatcctccacgtgggtgcgacacggcccctggacaagggtcttgagtggagtgggatggactaccaaaccccctaacaagtgggtacggacaacaaactntcgactaacagtaagtttcgagggtcagggtcaaccagtacgaaccgagggacaccggtacatcgacgcaacacgacctacagtggagtcagacgacgaacgacgtagaactactacgtacggaaccgacgaacccggtacccttaaattttacgttaaccgttggtacggtaaccggtaaggttaacggtttcgggtttaaccgggtcgggtttacgtttcgggttttttaacccggg

SEQ ID NO: 349319 - DNA, 574 bp, Homo sapiens
  misc_feature: GZ8MTXP02H4TQL.45.37.D04.1.454.CMB.2.raw
tcagacgcgatcgacacgaccggtgctcgatttagtagcatactgttgggtttggggagcatcacccagcaaccacatctgtcctctagagaatccccctgagagctccgttcctcaccatggactggacctggaggatcctcttcttggtggcagcagccacaagagcccactccccaggtgcagctggtgcagtctggggctgaggtgaggaagcctggggcctcagtgaaggtctcctgcaaggcttctggctacaccttcaccggcgactatctccacgtgggtgcgacacggcccctggacaagggcttgagtggagtgggatggatacaacccctaacgaatggtaggacaacaaaactatgacaccagtaagtttcgagggcacggggtacaccgtatacggaaccgagggaccaacgtaccaactaccgagaccacgaacgaccctaacgagtagggacgcgtagaacgcagactaggacatcgtagaaccgacgacggacctaatttactacgtgtacgcggtaaggtacgttcggtttacggtcggtcgtttcggttttaccgg

SEQ ID NO: 349320 - DNA, 720 bp, Homo sapiens
  misc_feature: GZ8MTXP02IQSF7.45.37.D04.1.454.CMB.2.raw
  modified_base (245)..(245): a, c, t, g, unknown or other
  misc_feature (245)..(245): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctgaggtgaggagccgtgggctcagtgagtctcctgcaggctcnggctacaccttcaccggcgactatctccacgtgggtgcgaccgacggccccctgggaacaaggggtcttgaggtggagtggggatggataccaaacccctaaacaagtgggtacggacaaacgaaactgtcgacacgaagttaacgttacgaggggtcgacgggtacacccgagtacggaaccgaacggggactaccggtacctaacgtacgacgaccgaaaccgaccggtacccttaacgaagtacggggaaacgtcccgtaggaaccggaccgaaggtaaacccgttaggaaacccgtaacttccggtaacggaaacccgggttaaaccgaaccccgggttaaacccttaaacgtttttaaccgttaacccggttggttacgggtaaccggggtaaggggtttaaccggttttaccgggtttttaaccgggggtttccggtttacgggtttttaccgggttttttaacccggg

SEQ ID NO: 349321 - DNA, 611 bp, Homo sapiens
  misc_feature: GZ8MTXP02JXIZN.45.37.D04.1.454.CMB.2.raw
tcagacgcgatcgacacgaccggtgctcgatttagtagcatactgttgggtttgggggagagcatcacccagcaaccacatctgtcctctagagaatccccctgagagctccgttcctcaccatggactggacctggaggatcctcttcttggtggcagcagccacaagagcccactcccaggtgcagctggtgcagtctggggctggaggtgaggaagccgtggggcctcagtgaaggtctctgcaaggcttctggctacaccttcaccggcgactatctccacgtgggtcgcgacacggcccctggacgaagggcttggagtggagtgggatggactacccaaaccctaacgaagtgggtcggacaacaactatgacaacgaagtaagtttacgaggggacgagggtacaccgagtcgaccgagggaccacggtaccagtcacgccaacgacgccctaacgagtcgggaagtcgtaggacgacgaacgacgtacggaactacgttacgacggaaccgaccgtaaccgggtaccttaacgtttaacttacgttggtaaggacggtaaggttacggttacggtttaccgggtcgggttcgtttttccgggg

SEQ ID NO: 349322 - DNA, 616 bp, Homo sapiens
  misc_feature: GZ8MTXP02GQEUQ.45.37.D04.1.454.CMB.2.raw
  modified_base (376)..(376): a, c, t, g, unknown or other
  misc_feature (376)..(376): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccacctcccaggtgcagctggtgcagtcgtggggctggaggtgaggaagccgtggggcctcgagtgaaggtctcctgcaggcttctggctacaccttcgaccggcgactactctccacgtgggtgcgacgcggccccgtggacgaagggcttgagtggagtgggatggataccaaacccctaacgaagtggtaggacaacgaaactntgacacgagtaagttcgaggggcagggtacaaccgatacggaaccgagggaccaccgtaccatcgacgcaacacgaccctaacagtacgggaacgtccgtaggacggacgaacgaccgtaggaactacgtacgtacggaaccgaaccgaccggtacttaaactttacttaccgtggtacgaacggtaggtacgtttacggggtttaccggtcggtttaccgtttacggttttttacccgg

SEQ ID NO: 349323 - DNA, 548 bp, Homo sapiens
  misc_feature: GZ8MTXP02JNEXV.45.37.D04.1.454.CMB.2.raw
  modified_base (253)..(253): a, c, t, g, unknown or other
  misc_feature (253)..(253): n is a, c, g, or t
  modified_base (373)..(373): a, c, t, g, unknown or other
  misc_feature (373)..(373): n is a, c, g, or t
  modified_base (472)..(472): a, c, t, g, unknown or other
  misc_feature (472)..(472): n is a, c, g, or t
  modified_base (487)..(487): a, c, t, g, unknown or other
  misc_feature (487)..(487): n is a, c, g, or t
  modified_base (509)..(509): a, c, t, g, unknown or other
  misc_feature (509)..(509): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcgagtgaaggtctcctgcaaggcttcgnggctacaccttcaccggcgactactcctccactgggtgcgacgacggccccgtggaccgaagggcttggagtggagtgggatggactacaacccctaacagtggtaggacaacgaaactntacgacacgaagaagttcgagggcgagggtccacgagtcgacgaggacacgtaccagtcacgcacgacgaccctagagtggacgcagagacgagtacgngacatcacgaccganaccggacttattaacgtcgtgngcgtaggtacgttcggttacggtgttccgttgttttccg

SEQ ID NO: 349324 - DNA, 617 bp, Homo sapiens
  misc_feature: GZ8MTXP02G2WIJ.45.37.D04.1.454.CMB.2.raw
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcgagtgaaggtctcctgcaggcttcgtggctacaccttcgaccggcgactactcctccacgtgggtcgccgaccgacgggccccctaggaaccgaaggggtcttaggaggtggagtggggatggactacccaaacctaacaagtggtacgactaacaacgtatcgacaagaagtaacgtttacgagggtacgagggtaccacgagtacgacgaggaccacgtacagtacacgacacgacgacctagagtcgggagtcgagacgacgaagaccgtagaactcgtacgacgaaccgaaccgtacggtacccttaagtttacgttaacgtcggtaacgtacggtacggttacgtttaccgggtttaccggttacggttcgtttttaccggg

SEQ ID NO: 349325 - DNA, 576 bp, Homo sapiens
  misc_feature: GZ8MTXP02JMJ3O.45.37.D04.1.454.CMB.2.raw
  modified_base (381)..(381): a, c, t, g, unknown or other
  misc_feature (381)..(381): n is a, c, g, or t
  modified_base (463)..(463): a, c, t, g, unknown or other
  misc_feature (463)..(463): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtgggggctgaggtgaggaagccgtggggcctcgagtgaaggtctctgcaggcttctggctacaccttcaccggcgactatcctccacgtggggtcgcgacacgggccccctggacaaggggcttggaggtgggagtggggatgggataccgaaaccctaaccgaagtgggtaggacaacaaaactntgcaacagtaagttcgagggcagggtacacagtcgaacgacggacacgtaccatacgagaccacgacgacctacatgggacncgtagagcgagactgaacatcgagacgacgacggtacctatttacttacgtcgtacgacgtaaggtacgtttacggtttaccgggtggttcgtttacggtttccgtttacggg

SEQ ID NO: 349326 - DNA, 669 bp, Homo sapiens
  misc_feature: GZ8MTXP02GACST.45.37.D04.1.454.CMB.2.raw
  modified_base (255)..(255): a, c, t, g, unknown or other
  misc_feature (255)..(255): n is a, c, g, or t
  modified_base (350)..(350): a, c, t, g, unknown or other
  misc_feature (350)..(350): n is a, c, g, or t
  modified_base (370)..(370): a, c, t, g, unknown or other
  misc_feature (370)..(370): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctcgagtgaaggtctcctgcaaggcttcgnggctacaccttcaccggcgactatcctccacgtgggtcgcgacgacggcccctggacaagggtctggagtggagtggatggataccaacccctanagtggtacgacaacaaactntgacaacgagtaagttacgagggctacgggtacaccgagtacgaccgaagggacaccgtacagtcagcaaaccgacgaccctaagacgtaggacgtacgtacggacgacgaaacgtaccgtaagaaccgtagtaccggtaaccggaaacccggtaacccgtaaacccggttaacctttaaaacgtttttaaccgttaaccgggttcggttaacgggtaacgggttaacgggtttaacggttttaccgggggtttaaccggggtttcggtttacccggtttttaccgggtttttacccgg

SEQ ID NO: 349327 - DNA, 555 bp, Homo sapiens
  misc_feature: GZ8MTXP02G4KNY.45.37.D04.1.454.CMB.2.raw
  modified_base (252)..(252): a, c, t, g, unknown or other
  misc_feature (252)..(252): n is a, c, g, or t
tcagacgcgatcgacacgaccggtgctcgattttagtagcatactgttggggtttgggggcatcacccagcaaccacatctgtcctctagagaatccccctgagagctccgttcctcaccatggactggacctggaggatcctcttcttggtggcagcagccacaagagcccactcccaggtgcagctggtgcagtctgggggctgaggtgaggaagccgtggggcctcagtgaaggtctctgcaggcttcnggctacaccttcacggcgactatctccacgtgggtgcgacacggcccctggacaagggcttgagtggagtgggatggataccgaaaccctaacaagtgggtagaccaactaaactatgacaacgaagtaacgtttcgagggcacgggtacacatacggaacgagggacacgtaccaatcaagcaacacgacctaacagtagggatcgagacgacaacggactagacagtcgagacgacacggacctattactacgtgtgacgaagtattacggttacgtgtacgtttcggtttacgtttacgg

SEQ ID NO: 349328 - DNA, 625 bp, Homo sapiens
  misc_feature: GZ8MTXP02H84QU.45.37.D04.1.454.CMB.2.raw
  modified_base (448)..(448): a, c, t, g, unknown or other
  misc_feature (448)..(448): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctgaggtgaggaagctgggcctgagtgaggtctcctgcaaggtcttcgtggctacacccttcaccggcgactactcctccacgtgggtgcgaccgacggcccctggaacaaggggcttggaggtggtaagtgggataggtactcaaacccccctaaagaagttggacggacaaacgaaacttagcgacaacaagtaagttcgagcagggtcaacgagtacgaaccgagggtaccacggtaccaacncgacgacaaacgcggtaccctagtagtacggaacgcgttagaacgaccaaggaccttagaccttagtccgtaacggaaccgaccgtaaccggtacccttaaattttacgtaaccgtttgtacggaaccggtaggtaacgttcggtttaacccggtggtcgttttacggttttcccgg

SEQ ID NO: 349329 - DNA, 646 bp, Homo sapiens
  misc_feature: GZ8MTXP02F43CQ.45.37.D04.1.454.CMB.2.raw
  modified_base (239)..(239): a, c, t, g, unknown or other
  misc_feature (239)..(239): n is a, c, g, or t
  modified_base (249)..(249): a, c, t, g, unknown or other
  misc_feature (249)..(249): n is a, c, g, or t
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
  modified_base (291)..(291): a, c, t, g, unknown or other
  misc_feature (291)..(291): n is a, c, g, or t
  modified_base (617)..(617): a, c, t, g, unknown or other
  misc_feature (617)..(617): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaggtctcngcaaggctcnggctacaccttcacggcgactntctccacgtgggtcncgacncggcccctggacaagggcttggacgtgggagtggggagtgggactaccgaaaccctaacgtaagtcgggtacggaaccaacgtaaaaccttagtcggaccaacgtaaggtaaacggtttcgaacgggggtacgaacgggggttaccaaccgttacgacggaacccggaacgggaaccgtaccggtacccaacgtacgaacgaccaacgaacgtaccgtacgaacgtagggactacgtagacgacaagacgtacgactactcgacgacgaccgaacggtacctaatttacgtacgtgtggtacggtaagtacgttacggtttacggngtttaccgttcggtttaccgtttaacggg

SEQ ID NO: 349330 - DNA, 540 bp, Homo sapiens
  misc_feature: GZ8MTXP02H3HNY.45.37.D04.1.454.CMB.2.raw
  modified_base (363)..(363): a, c, t, g, unknown or other
  misc_feature (363)..(363): n is a, c, g, or t
  modified_base (434)..(434): a, c, t, g, unknown or other
  misc_feature (434)..(434): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgccgacacggcccctggacaagggcttgagtggatgggatggatcaaacccctaacaagtggtggacaacaaactntgacacagtaagttcgaggcacgggtcaaccagcgaaccgagggacacgtccaagtcagcacagccctaanagaggacgcagaggcaagtcacgacactctaggaacacgaacggaccttatttaacttacgtgtagcgtaaggattcggttacccggtgtcgtttcggttttcccg

SEQ ID NO: 349331 - DNA, 652 bp, Homo sapiens
  misc_feature: GZ8MTXP02FQF1O.45.37.D04.1.454.CMB.2.raw
  modified_base (375)..(375): a, c, t, g, unknown or other
  misc_feature (375)..(375): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcaggcttctggctacacctcaccggcgactatcctccacgtgggtgcgacgcggcccctggacgaagggcttgaggtggagtgggatggactacaaaccccctaacaagtgggtaggacaaacgaaactntacgacaaacgaagtaacgtttacggaggggacgaaggggtccaacccgtaagtacgaaacccgaagggggaccaccggtacccaactcgacgacaacgacgaccctaacgagtcgggaacgccgtaggaacggaccgaagaccgtaggaaacctacgtacgtacggaccggaaccaccgggtaccttaaagttttacgttaacgttggtacggaacgggtaagggttaacgtttacgggtttaccgggttgggtccgttttcggggtttttacccg

SEQ ID NO: 349332 - DNA, 578 bp, Homo sapiens
  misc_feature: GZ8MTXP02HIW9A.45.37.D04.1.454.CMB.2.raw
  modified_base (370)..(370): a, c, t, g, unknown or other
  misc_feature (370)..(370): n is a, c, g, or t
  modified_base (445)..(445): a, c, t, g, unknown or other
  misc_feature (445)..(445): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctgggggcctcagtgaaggtctcctgcaaggcttcgtggctacaccttcaccggcgactatcctccacgtgggtcgcgacacggcccctggacaagggtcttggagtggatgggagtggatcaaaccccctacgaagtcggtagcaacaaactntcgcacagtagttacgaggggcagggtcactagcgacgacggacacgcacgtcgacgacacagcctacagtggancagagcgagacgtagactctacgtacggaccgacgaccggtccttaagtttaacgttaccgttgtacggaaccggtaacgggttatttaccgggggtttaccggtcggggtttcgttttacgggtttttccgg

SEQ ID NO: 349333 - DNA, 588 bp, Homo sapiens
  misc_feature: GZ8MTXP02HQHWC.45.37.D04.1.454.CMB.2.raw
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
  modified_base (286)..(286): a, c, t, g, unknown or other
  misc_feature (286)..(286): n is a, c, g, or t
  modified_base (291)..(291): a, c, t, g, unknown or other
  misc_feature (291)..(291): n is a, c, g, or t
  modified_base (334)..(334): a, c, t, g, unknown or other
  misc_feature (334)..(334): n is a, c, g, or t
  modified_base (357)..(357): a, c, t, g, unknown or other
  misc_feature (357)..(357): n is a, c, g, or t
  modified_base (415)..(415): a, c, t, g, unknown or other
  misc_feature (415)..(415): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggctgaggtgaggaagccgtggggcctnagtgaggtctcctgcaaggtctcnggctacaccttcaccggcactatctccacgtgggtncgacncggcccctggacaggctgagtgagtggatgatcaaacccctanaagtggtacgacaacgaaacttnacgacacgagtaacgttcgagggcaggtacactagtacgaccgaggactaccgtacanacgagaccaacgcgacctacgagtacggacgcgtagacgacaacgtacgtagaacctagtacgtacggaaccgaaaccgaccggtaccttaaatttacgttaaccgtggtacgaacggttaggtacgtttacggggtttaaccggtcggttaaccgtttcggtttttacccgg

SEQ ID NO: 349334 - DNA, 674 bp, Homo sapiens
  misc_feature: GZ8MTXP02H8K72.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctgaggtggaggaagccgtggggcctcgaggtgaaggtctccgtgcgaaggtcttcgtggctaccacccgttcaccggcgtaactactctacccagtgggtgaccgaccgcggccccgtaggacgaaggtcgttaggaggtggagtgggagtggaactaccaaaccccgtaagaagtcggaggacaacgaaactgtacgacaacgtagtaagttcggaggtacgacggtaccaacgtacgtacgaacccggacggaaccaccgtaccaacgtccgacgacgaaccgacgtaccgtacgtaagtagggacggacgtaacgacgacgaacggtaacccgtagaccgtaacgtaccggtacgaaacccggtaccgaaccgggtacccttaaattttaccgttacgttaggttacggaacgttaagggtacgtttacgggttaccggtcggttaccgttttcgggttttacccgg

SEQ ID NO: 349335 - DNA, 593 bp, Homo sapiens
  misc_feature: GZ8MTXP02GI9YA.45.37.D04.1.454.CMB.2.raw
  modified_base (370)..(370): a, c, t, g, unknown or other
  misc_feature (370)..(370): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttctggctacaccttcaccggcgactatctccacgtgggtgcgacacggcccctggacaagggcttggagtggagtgggatggactcaaaccccctaacgaagtggtggacaacgaaactntgacaacagtaagtttcgaggggtcgacggtacacgagtacgacgaagacaccgtacacgtacgacgaccaacgtaccgaccgtaacgagtagggacgtacgacggacgacgaacgtacgacgactacgttcgacgaaccgaccgaccggtaccttatttacgtacgtggtcggaacggtaggtacgtttcgggttacggtcggttcgtttcggtttttacgg

SEQ ID NO: 349336 - DNA, 660 bp, Homo sapiens
  misc_feature: GZ8MTXP02JUP55.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggagggccaccatcaactgacaagtccagccagtagttgtttagacagcctaccaaacaaataagaactacttagacttaggtaccagacaacgaaaccaggtcacgtccctaccgtaagctgctactatttacgtcggactacgtaccgtaaccccggggaacgttcccggggtaccccctaggtaaccgtattccgaggtcggcgtcggggaccggggtcgtagggactaggttactttccgactcctacaccctatcgaacgcctacgcccgtggacgtacggacgtaaggaaacgtaggttcgtaacgggtcgttaagttttcgtcgtacgtgtacagtattaattatttaattacgttaccttcccgttacgtaccgttccggtacccgtagggtaaacccgtaaggtacgtaaacgtaacgtaaccgtaaaacgtgtacggtacgtacgtaccgg

SEQ ID NO: 349337 - DNA, 521 bp, Homo sapiens
  misc_feature: GZ8MTXP02FM7DO.45.37.D04.1.454.CMB.2.raw
  modified_base (359)..(359): a, c, t, g, unknown or other
  misc_feature (359)..(359): n is a, c, g, or t
  modified_base (453)..(453): a, c, t, g, unknown or other
  misc_feature (453)..(453): n is a, c, g, or t
  modified_base (483)..(483): a, c, t, g, unknown or other
  misc_feature (483)..(483): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagcctgggggcctcagtgaaggtctcctgcaaggcttctggctacaccttcaccggcgactatctccactgggtgcgacaggcccctggacaaggcttgagtggatgggatggatcaaccccctaacaatggtggacaacaaactntgacacgagaagtttcgagggcgagggtcacatgaccgaggacacgtcatcagcacacgcctacagtaggagctagaggacagactgacagtcncgacgacgacgacctattactactgttcgnggtacgagttcggttacggtggtcgttcggttttaccg

SEQ ID NO: 349338 - DNA, 569 bp, Homo sapiens
  misc_feature: GZ8MTXP02IHZ7K.45.37.D04.1.454.CMB.2.raw
  modified_base (252)..(252): a, c, t, g, unknown or other
  misc_feature (252)..(252): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctggggcctcagtgaaggtctcctgcaaggcttcnggctacaccttcaccggcgactatctccactgggtgcgacacggcccctggacaagggctgagtggatgggatggatcaacccctaacatggtacggacaacaaaactatacgacaaccgaagtaacgtttcgaagggcgaaggggtacaaccgaagtacgaccgaaaggggacaaccggtaccaataccgaagcaacgaacgctaacagttacggagctagagacaggactagacatctacgacgacacgacctaatttacttaactgtgaacggtagtacgttcggttaacggttcggtcgtttacgtttttccg

SEQ ID NO: 349339 - DNA, 506 bp, Homo sapiens
  misc_feature: GZ8MTXP02FL239.45.37.D04.1.454.CMB.2.raw
tcagacgcgatcgacacgaccggtgctcgatttagtagcatactgttgggtttgggggagcatcaccccagcaaccacatctgtcctctagagaatccccctgagagctccgttcctcaccatggactggacctggaggatcctcttcttggtggcagcagccacaagagcccactcccaggtgcagctggtgcagtctgggggctgaggtgaggaagcctgggggcctcagtgaaggtctcctgcaaggcttctggctacaccttcaccggcgactatctccactgggtgcgacaggcccctggacaagggcttgagtggatgggatggatcaaccccctaacaatggtggcacaaaactatgcacagaagtttcagggcaggggtcaccgatgaccagggacacgtaccatcagcacagcctacatggagctgagcagactgacatctagacgacacggccatttaatactgtgcgagatgttaccggtggtcgtggttttccg

SEQ ID NO: 349340 - DNA, 541 bp, Homo sapiens
  misc_feature: GZ8MTXP02HSNY6.45.37.D04.1.454.CMB.2.raw
  modified_base (451)..(451): a, c, t, g, unknown or other
  misc_feature (451)..(451): n is a, c, g, or t
  modified_base (462)..(462): a, c, t, g, unknown or other
  misc_feature (462)..(462): n is a, c, g, or t
  modified_base (498)..(498): a, c, t, g, unknown or other
  misc_feature (498)..(498): n is a, c, g, or t
  modified_base (505)..(505): a, c, t, g, unknown or other
  misc_feature (505)..(505): n is a, c, g, or t
  modified_base (523)..(523): a, c, t, g, unknown or other
  misc_feature (523)..(523): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagaacccactcccaggtgcagctggtgcagtctggggctgaggtgaggaagccgtgggcctcagtgaaggtctctgcaaggcttctggctacaccttcaccggcgactatctccactgggtgcgacacggcccctaggacgaagggcttggaggtgggagtggggatgggactcgaaaccctaaccaagtcggtggacaacaaactatgcaacagtaagttcgagggcagggtcacagtcgaccgagggtacacgtccatcagcacacgaccttacagtggagtcgngagcgagacgngacacgtcgagacgaacaccggactatttacttacngtcgagngtagttcggtttacgggngtcgtttcgtttcgttag

SEQ ID NO: 349341 - DNA, 596 bp, Homo sapiens
  misc_feature: GZ8MTXP02H53B4.45.37.D04.1.454.CMB.2.raw
  modified_base (274)..(274): a, c, t, g, unknown or other
  misc_feature (274)..(274): n is a, c, g, or t
  modified_base (471)..(471): a, c, t, g, unknown or other
  misc_feature (471)..(471): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctctgcaaggcttctggctacaccttcaccggcgactanctccacgtggtgcgacacggcccctggacaaggcttggagtgggagtggggatgggactaccgaaaccctaacgaagttcggggtaggaccgaactaaacgttatcggacaacgtaaggtaaagttttcgacggggcgtacgggtaccaccagtcgaaccgagggacacgtaccatcaacgcacgacgcctaacagnggtagctagagcaagctagacactcgtacgaccgacgtaccggacttaagtttactaccgtggtcggacggtaagtacggtttacggtttaccggtggttaccgtttcggttttacttttacggg

SEQ ID NO: 349342 - DNA, 558 bp, Homo sapiens
  misc_feature: GZ8MTXP02ITV5K.45.37.D04.1.454.CMB.2.raw
  modified_base (257)..(257): a, c, t, g, unknown or other
  misc_feature (257)..(257): n is a, c, g, or t
  modified_base (345)..(345): a, c, t, g, unknown or other
  misc_feature (345)..(345): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctggggcctcagtgaggtctcctgcaggcttctggctacnccttcaccggcgactatcctccacgtgggtgcgacgacggcccctggaccaagggcttgagtggatgggatggatcgaaccccctaanaatggtggcaacaaactgtgcacgagtaagtttcgaggggcaggggtcaccgatcgaccgagggacacgtcatcagcacacgcctacgagtgggagtaccgtggacgccaggactacggaacagtaccgtacgacgacacggtacctaattttactacttggtagcggtaaggtacgttcggtttaaccggtcggttcgtttcggtttttccg

SEQ ID NO: 349343 - DNA, 608 bp, Homo sapiens
  misc_feature: GZ8MTXP02HT7K3.45.37.D04.1.454.CMB.2.raw
  modified_base (282)..(282): a, c, t, g, unknown or other
  misc_feature (282)..(282): n is a, c, g, or t
  modified_base (338)..(338): a, c, t, g, unknown or other
  misc_feature (338)..(338): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctgggcctcagtgaggtctctgcaaggctctggctacaccttcaccggcgactatctccactgggtncgacacggcccctggacaagggcttgagtggatgggatggatcgaaaccccctaanaagtggtacggcaaccgaaaactgtagcaacgtagtaaacgtttcgaaggggtcagggtaccaaccgagtcgaccgagggaacaccgtaccatcgaagcaacgacgacccttaacgagttacgggaagtccgtagaacgaccaaaggacccttaggaaacccagttccgtaggaaaccgaccgaaccggtacctaagttttactaacgtgttacggaacgtagggtacttacgggtttaaccgggtcggtacgttttacggtttttcccg

SEQ ID NO: 349344 - DNA, 609 bp, Homo sapiens
  misc_feature: GZ8MTXP02HP2YO.45.37.D04.1.454.CMB.2.raw
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
  modified_base (378)..(378): a, c, t, g, unknown or other
  misc_feature (378)..(378): n is a, c, g, or t
  modified_base (442)..(442): a, c, t, g, unknown or other
  misc_feature (442)..(442): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagctggggcctnagtgaggtctctgcaggcttcnggctacaccttcgaccggcgactatctaccacgtgggtgcgacgacggccccagtaggacgaagggtcttggaggtggagtggggatgggatacccaaaccctaacgaagtcggtaggacaactaacttagnactaacaggtaaacgtttcgagggacgagggtaccacgagtcgaccgaagggaccacggtccancacgacacgacaccttaacagtcgggaagcgtaggacgaacgtaacgacgtacgaactacgtacgtaccgaccgtaacgtaccgttacttaacgtttacgttacgtaggtaacggtacggtacggttacggtttacgggtttaccgggtcggtttaccggttttcgg

SEQ ID NO: 349345 - DNA, 611 bp, Homo sapiens
  misc_feature: GZ8MTXP02HGRGU.45.37.D04.1.454.CMB.2.raw
  modified_base (184)..(184): a, c, t, g, unknown or other
  misc_feature (184)..(184): n is a, c, g, or t
  modified_base (250)..(250): a, c, t, g, unknown or other
  misc_feature (250)..(250): n is a, c, g, or t
  modified_base (287)..(287): a, c, t, g, unknown or other
  misc_feature (287)..(287): n is a, c, g, or t
  modified_base (460)..(460): a, c, t, g, unknown or other
  misc_feature (460)..(460): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtncagctggtgcagtcgtggggctggaggtgaggagcgtggggctgagtgagtctctgcaggcttcgngctacacctcgaccgcgactatcctccgacgtgggcncgacgacggcccctggacgaagggtcttagggagtggagtacggggataggactacccgaaaccctaaacgagttcggggagaccaaactaacgttagacgaaccacgtaaggtaacgtttacgaacgggtcgaacggtaccaaccgtagacgaacgacgggaccaccgtacncacgagacacgcgacctagacgtaggacgcgagacggacacggtacacgactaacgttccgaaggacctaacgaccgttaccttaagtttacgtaccgttgtcgtacggtaaggttacgttacgggtttaccggtcggtttacgttttcgg

SEQ ID NO: 349346 - DNA, 594 bp, Homo sapiens
  misc_feature: GZ8MTXP02HTONK.45.37.D04.1.454.CMB.2.raw
  modified_base (464)..(464): a, c, t, g, unknown or other
  misc_feature (464)..(464): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttcgtggctacaccttcaccggcgactatcctccagtgggtgcgacacggcccctaggacgaagggcttaggagtggagtgggatggactacccaaacctaacagtcgggtagaccaacaactatcgacacaaggtaacgtttcgaggggcgaagggtccaacgagtacggaaccgagggaccaacggtaccatacgagacacgacgaccttanacgtggagctaggagcgaaggtacagaactagttcgacgaaaccgacgaaccggtaccttaatttacgttacgtagtaacggtcgtaagggttacgtttacggtttaccgggtcggttacgtttttcggg

SEQ ID NO: 349347 - DNA, 614 bp, Homo sapiens
  misc_feature: GZ8MTXP02HZ8X7.45.37.D04.1.454.CMB.2.raw
  modified_base (249)..(249): a, c, t, g, unknown or other
  misc_feature (249)..(249): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctctttcttggtggcagcagccacaagacgcccactcccaggtgcagctggtgcagtctggggctgaggtgaggaagcgtgggcctgagtgaaggtctctgcaggctcnggtcacacctcgaccggcgactatctccagtggtgcgacgcggcccgtagacgaggcgttgaggtggagtgggagtggactaccaaccccgtaacgaagtgggtacgacaaactaaacgtatacgacaacgtaagttaaacgtttacggagggtacgaacggggtacaaccgtaacgtacggaacccggaaggggtaccaaccggtaccaacgacgacgaaccacgtaccggaccttacaagtaggacgcgagaaccgagaagacgtagacgatacgtacgacggaaccgacgtaccttaatttaccgtagtcggtacgaaggtagtacgttacggttcgggtcgttcggtttacggttttccgg

SEQ ID NO: 349348 - DNA, 601 bp, Homo sapiens
  misc_feature: GZ8MTXP02JDQEZ.45.37.D04.1.454.CMB.2.raw
  modified_base (373)..(373): a, c, t, g, unknown or other
  misc_feature (373)..(373): n is a, c, g, or t
  modified_base (460)..(460): a, c, t, g, unknown or other
  misc_feature (460)..(460): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcgagtgaaggtctcctgcaaggcttctggctacaccttcaccggcgactatccgtccacgtgggtgcgaccaggcccctggacgaagggcttggagtggagtgggatggatccaaaccccctaacaagtggtggacaacgaaactntgacacagtaagtttcgagggtcaggggtcaccatacgaccaggggacaccgtcactcagcaacagacctacagtacggagtaccgnggaacgacgaaggtactacggaactagtaccgtaaggacccggaacgaccgggtaccttaaactttacgttaacgtcggttaggaacggtaacggtagtttacggtttaacccggtcggtacgtttcggttttttacccgg

SEQ ID NO: 349349 - DNA, 619 bp, Homo sapiens
  misc_feature: GZ8MTXP02FKOHD.45.37.D04.1.454.CMB.2.raw
  modified_base (225)..(225): a, c, t, g, unknown or other
  misc_feature (225)..(225): n is a, c, g, or t
  modified_base (343)..(343): a, c, t, g, unknown or other
  misc_feature (343)..(343): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctnagtgaaggtctcctgcaaggcttctggctacaccttcaccggcgactatctccactgggtgcgacacggcccctggacaagtggcttgagtggatggggatggatacccaaccctaanaatggtcgaacaacaactatcgacaacagtaagtttacgaggggtcgtagggtccaaccgagtacgaaccgaggggaccaccggtaccaagtacgacgaccaaccgaagacccctaacgaagtagggaagccgtagaacggaccaggaacgtcgaacagtaccgtacggaaccgaaccgaacgggtacccttaatttttaacgtaaccgttagggtaacgtaccggaaagggtacgtttacggggttttacccgggtgggtaccggtttttcgggg

SEQ ID NO: 349350 - DNA, 644 bp, Homo sapiens
  misc_feature: GZ8MTXP02HZHCS.45.37.D04.1.454.CMB.2.raw
  modified_base (226)..(226): a, c, t, g, unknown or other
  misc_feature (226)..(226): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtctggggctggaggtgaggagcgtgggcctnagtgaaggtctctgcaaggtcttcgtggctacaccttcgaccggcgtactactccgtaccacgtggtcgcgtacgacggcccagtcggacaaggggtctttaggaggttggagtggggtatacgggtactaccccgaaacccgttaaacgaggttgggtacgacgaaactaactgtacgaccaacgtaaggttaacgtttcgaaggggtacgtagggtaccaacgagtacggaacccggaaggacccgtaccggtaccaacgtacgacgaccgaacgacggaacccttaagacgtagggacgtacgtaggacgacgaacgtacgtacgaactagttaccgacgaaccgacgtaaccggtaccttaagtttactacgtgaacgacgtaaggtcgttacggttaccgtgttacgtttcgg

SEQ ID NO: 349351 - DNA, 605 bp, Homo sapiens
  misc_feature: GZ8MTXP02JZVHV.45.37.D04.1.454.CMB.2.raw
  modified_base (366)..(366): a, c, t, g, unknown or other
  misc_feature (366)..(366): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtgggggcctcagtgaaggtctcctgcaaggcttctggctacaccttcaccggcgactatctccactgggtgcgacaggccccctggacaagggcttggagtggatgggatggactacaaccccctaacaagtggtaggcaacaaactngacaacagtaagtttcgagggcagggtaccaccgagtgaccgagggacacgtcatcagcacacgcctacgagtacggacgactagacgacgaacggacttacggaactaagtcgtacggaaccgaaccgaacccgggtacccttaagttttaacgtaaccgttaggttacggaaccggtaaaggtacgtttacgggtttaacccgggtcgggttaccgtttcgggttttttaaccccgg

SEQ ID NO: 349352 - DNA, 603 bp, Homo sapiens
  misc_feature: GZ8MTXP02H1RHT.45.37.D04.1.454.CMB.2.raw
  modified_base (332)..(332): a, c, t, g, unknown or other
  misc_feature (332)..(332): n is a, c, g, or t
  modified_base (440)..(440): a, c, t, g, unknown or other
  misc_feature (440)..(440): n is a, c, g, or t
  modified_base (490)..(490): a, c, t, g, unknown or other
  misc_feature (490)..(490): n is a, c, g, or t
tcagacgcgatcgacacgaccggtgctcgatttagtagcatactgttgggtttgggggagctaaaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggccaccatcaactgacaagtccagccagtagttgtttagacagctaccaaacaataaagaactactagtcttaggtaccagacaagaaaccaggtaccacgcctacctaagctgtctctatttacgngggctacgtaccgaaccccggggtaacgtcccggggtcctacggacccgtgttacgaggtcggcgacggtcggggtcgtgggactagttactttcacttcaccacgtntcacgtcacgcctagcgaggctagaagagttgtagggacttagtttacgngtactgtacagtactaaattattatatacctttccgtacgttacgttccgaccgtacggtaacctaaaggttcgaataacgtaacgaaaacgtaccgtgtacggctagacccg

SEQ ID NO: 349353 - DNA, 539 bp, Homo sapiens
  misc_feature: GZ8MTXP02FU4YH.45.37.D04.1.454.CMB.2.raw
  modified_base (184)..(184): a, c, t, g, unknown or other
  misc_feature (184)..(184): n is a, c, g, or t
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
  modified_base (277)..(277): a, c, t, g, unknown or other
  misc_feature (277)..(277): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
  modified_base (364)..(364): a, c, t, g, unknown or other
  misc_feature (364)..(364): n is a, c, g, or t
  modified_base (432)..(432): a, c, t, g, unknown or other
  misc_feature (432)..(432): n is a, c, g, or t
  modified_base (445)..(445): a, c, t, g, unknown or other
  misc_feature (445)..(445): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtncagctggtgcagtctggggctgaggtgaggaagcctggggcctcagtgaaggtcncctgcaaggcttcnggctacaccttcaccggcgactanctccatgggtncgacncggcccctggacagggcttgagtggatgggatggactcccaaaccctaacaagtgggtacgacaacaactntgacacgagtaagtttcgagggcgagggtacacagtcgacgagggacacgtccatcagcacagcctanagtagggactcgngagacgaagactagactatcgtagacgacaccggtacctatttactacgtagtgacggtaggtacgttggtttaccggtggttaccgtttcggg

SEQ ID NO: 349354 - DNA, 594 bp, Homo sapiens
  misc_feature: GZ8MTXP02HVJE7.45.37.D04.1.454.CMB.2.raw
  modified_base (229)..(229): a, c, t, g, unknown or other
  misc_feature (229)..(229): n is a, c, g, or t
  modified_base (463)..(463): a, c, t, g, unknown or other
  misc_feature (463)..(463): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctnagtgaaggtctccgtgcaaggcttcgtggctacaccttcaccggcgactactcctccacgtggggtcgccgacgacggccccctggacaaggggcttaggagtggatggggatggactaccgaaccctaacaagtgggtgaccaacaacttgtcgacaaccgtaagtaaacgtttcgagggcgagggtacacgatcgaaccgagggaccacgtccatcgagcactacgacctanagtcgggaacgtcgagaacggaccgagacgtacgactactcgtacggaccgaacgaccggtaccttagtttaacttacgtggtaacggtacgaggttacgtacggttttaccggggtgttcggttttcggg

SEQ ID NO: 349355 - DNA, 642 bp, Homo sapiens
  misc_feature: GZ8MTXP02IFC6S.45.37.D04.1.454.CMB.2.raw
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
  modified_base (249)..(249): a, c, t, g, unknown or other
  misc_feature (249)..(249): n is a, c, g, or t
  modified_base (538)..(538): a, c, t, g, unknown or other
  misc_feature (538)..(538): n is a, c, g, or t
  modified_base (594)..(594): a, c, t, g, unknown or other
  misc_feature (594)..(594): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtctggtgctgaggtgaggagccgtgggctngtgaggtcncctgcaaggcttcgngcacaccttcaccggcgactatcctccgacgtggggtgccgaccgaccggcccccgtagggaccgaaggggtctttaggaggtggagtgggatggactacccgaaacccctaagaagtcggtaggaccaactaactagtgacctaaagaacgtaaacggtttcgaacgggggacgtacggggtaccaaacccgtaagtaccggaacccgaacgggaacccgtacggtacccaacgtaccgacgaccgaacccgaacgtacccttaacgagtcgggaacgtcgtacggancgagacctaggactatcgacggaacgaactaccggtacttacgtttaacgttacgngtaacggacgtaggtacgtttcgggtttacggtcggttacgttttcgg

SEQ ID NO: 349356 - DNA, 529 bp, Homo sapiens
  misc_feature: GZ8MTXP02F4AX6.45.37.D04.1.454.CMB.2.raw
  modified_base (349)..(349): a, c, t, g, unknown or other
  misc_feature (349)..(349): n is a, c, g, or t
  modified_base (367)..(367): a, c, t, g, unknown or other
  misc_feature (367)..(367): n is a, c, g, or t
  modified_base (396)..(396): a, c, t, g, unknown or other
  misc_feature (396)..(396): n is a, c, g, or t
  modified_base (412)..(412): a, c, t, g, unknown or other
  misc_feature (412)..(412): n is a, c, g, or t
  modified_base (431)..(431): a, c, t, g, unknown or other
  misc_feature (431)..(431): n is a, c, g, or t
  modified_base (487)..(487): a, c, t, g, unknown or other
  misc_feature (487)..(487): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtgggggcctcgagtgaaggtctcctgcaggcttctggctacaccttcaccggcgactatctccacgtgggtgcgacacggccccctggacaagggcttggagtggagtgggatggatcaaaccccctaanagtggtgacaacaaactngacacgagaagttcagggcagggtcacanagacagggacacgcancagcacagcctacatgganctagagacagactgactatcgacgaacgacgacggccttaatttactacgtgtagngtaacgtagttcgttaccggtggtacgttggtttttacccgg

SEQ ID NO: 349357 - DNA, 635 bp, Homo sapiens
  misc_feature: GZ8MTXP02FMWHL.45.37.D04.1.454.CMB.2.raw
  modified_base (250)..(250): a, c, t, g, unknown or other
  misc_feature (250)..(250): n is a, c, g, or t
  modified_base (322)..(322): a, c, t, g, unknown or other
  misc_feature (322)..(322): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttagacagctaccaaanaataagaactactagcttaggtaccagcaacgaaaccaggtccagcctacctaagctcgctctaatttacgngggactactccgtacccgggtaacgtccggggtcccccctaggaccccgtattaccgaggttcggcgtacggccggggtctacgggggacctagtactttcgacttcctacaccactcagcacgcccgtgccgtagacctagaaacgtagttggtcgacgttaggttttactggtaccttaggacctaggtacctaaagttaacttttataacgttacgtttaccctccggttactttccgggtaccctaggggtaaacccaagttacggtaattaacgtaacctaaaacggtacgtttggcggacttaacgg

SEQ ID NO: 349358 - DNA, 626 bp, Homo sapiens
  misc_feature: GZ8MTXP02GWBU6.45.37.D04.1.454.CMB.2.raw
  modified_base (250)..(250): a, c, t, g, unknown or other
  misc_feature (250)..(250): n is a, c, g, or t
  modified_base (365)..(365): a, c, t, g, unknown or other
  misc_feature (365)..(365): n is a, c, g, or t
  modified_base (399)..(399): a, c, t, g, unknown or other
  misc_feature (399)..(399): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttntggctacaccttcaccggcgactatctccactggtgcgacgacggcccctggacaagggcttggagtggatgggatggataccaaccccctaacaagtggtacggcaacaaactntagcacgagaagtttcgaggggtcagggtcaccngtacgaccgaagggacaccgtccacgtcacgacaacgacgaccctaaccgtagtacgggtacgaccgtaggaacgacgtaacgggaaaccttcggaaccgtacttaccgtacggaaaccgtaccgaacccgggtacccttaacgttttaaactttaccgtcggttagaaccggttaaggtacgtttacgggtttaccgggtacggtacgtttcgggtttttacccgg

SEQ ID NO: 349359 - DNA, 610 bp, Homo sapiens
  misc_feature: GZ8MTXP02IYZ4C.45.37.D04.1.454.CMB.2.raw
  modified_base (362)..(362): a, c, t, g, unknown or other
  misc_feature (362)..(362): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcgaaggcttcgtggctacaccttcgaccggcgactatcctccacgtgggtgcgacgacggcccctaggacgaagggctttggagtggagtgggatggactaccccaaaccctaanaagtggtacgacgaacaacgtatcgacaacgagtaacgtttcgagggacgacggggtaccaaccgagtacggaacccgaaggggaccaccggtaccacgaccgagaccaacgacgacctacgagtggaacgcaggacgacacggactagacatacgacgaccgacgaccggaccttaagtttaacgttcgtacgtggtaccggtaggttacgttacggtttaccgggtcggttccgtttttaccgggg

SEQ ID NO: 349360 - DNA, 536 bp, Homo sapiens
  misc_feature: GZ8MTXP02JR340.45.37.D04.1.454.CMB.2.raw
  modified_base (345)..(345): a, c, t, g, unknown or other
  misc_feature (345)..(345): n is a, c, g, or t
  modified_base (430)..(430): a, c, t, g, unknown or other
  misc_feature (430)..(430): n is a, c, g, or t
  modified_base (453)..(453): a, c, t, g, unknown or other
  misc_feature (453)..(453): n is a, c, g, or t
  modified_base (459)..(459): a, c, t, g, unknown or other
  misc_feature (459)..(459): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactactctccacgtgggtgcgacacggcccctggaccaagggcttgagtggatgggatggatcaaaccccctaanaagtggtggacaacaaactatgacacgagtaagtttacgagggtcagggtcaccgatcggaccaggggacacggtcatcagcacngcctacatggagcagagcagacngactancgtagacgacgacggcctaatttactactggtagcgaaggtacgttacggttacggtcggtcgtttcggtttttccg

SEQ ID NO: 349361 - DNA, 648 bp, Homo sapiens
  misc_feature: GZ8MTXP02J1UFH.45.37.D04.1.454.CMB.2.raw
  modified_base (391)..(391): a, c, t, g, unknown or other
  misc_feature (391)..(391): n is a, c, g, or t
  modified_base (472)..(472): a, c, t, g, unknown or other
  misc_feature (472)..(472): n is a, c, g, or t
  modified_base (481)..(481): a, c, t, g, unknown or other
  misc_feature (481)..(481): n is a, c, g, or t
  modified_base (507)..(507): a, c, t, g, unknown or other
  misc_feature (507)..(507): n is a, c, g, or t
  modified_base (513)..(513): a, c, t, g, unknown or other
  misc_feature (513)..(513): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctctgcaggcttcgtggctacaccttcaccggcgtactatctaccacgtgggtcgccgacgaccggccccctagggaaccgaacggggtcttaggaggtgggagtggggattgggactaccaaaccccccgttaagagtggggtacgaccaanaaacgttgagaccaacgtaggtaaagtttcgaaggggaccgaggggttaccaacgtagtacggaacccggaagggtaaccnccgtacganacgacgacacgacgtacaacgtaggnggacgngacgacgacgacgtacgtacgacgtacgtacgaccgaacgaccgtaccgttacttacgtttacgtacggttacgacggtaacggtacggttacggtttacgggttaccggttcggtttaccggtttcggtttacg

SEQ ID NO: 349362 - DNA, 599 bp, Homo sapiens
  misc_feature: GZ8MTXP02J1NA6.45.37.D04.1.454.CMB.2.raw
  modified_base (372)..(372): a, c, t, g, unknown or other
  misc_feature (372)..(372): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcgagtgaaggtctcctgcaaggcttcgtggctacaccttcaccggcgactactctccagtgggtgcgacgacggccccgtaggacgaagggcttggagtggagtgggatggataccaacccctaacagtggtagacaacaaactntcgacacagtagttcgagggcgaggtcacgatacgaccgaggacacgtccgatcgagcacgacgacctacgagtagggacgacgtagacgacgacggactggaactacgttacgacggaaccgaaccgtaccgggtaccttaagttttacgttaaccgtggtacggtcggtaagggttacgttacgggtttacccggggtggtttaccggtttcgggtttttcccgg

SEQ ID NO: 349363 - DNA, 529 bp, Homo sapiens
  misc_feature: GZ8MTXP02I7T50.45.37.D04.1.454.CMB.2.raw
  modified_base (289)..(289): a, c, t, g, unknown or other
  misc_feature (289)..(289): n is a, c, g, or t
  modified_base (340)..(340): a, c, t, g, unknown or other
  misc_feature (340)..(340): n is a, c, g, or t
  modified_base (355)..(355): a, c, t, g, unknown or other
  misc_feature (355)..(355): n is a, c, g, or t
  modified_base (421)..(421): a, c, t, g, unknown or other
  misc_feature (421)..(421): n is a, c, g, or t
  modified_base (430)..(430): a, c, t, g, unknown or other
  misc_feature (430)..(430): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacacttcaccggcgactatcctccactgggtncgacaggcccctggacaagggcttgagtgatgggatggactccaaccctanatggtgacacaactntgcacagtaagttcgagggcagggtcacatgaccgaggacacgtccatcagcacgtagtaccctanatgggaacncgaggacgacgtaagactagacacgtacgacgacgaccgtaacgtacttacgttactacgtgtaagacgtagtacgttcggttacgtcgttcgtttcgg

SEQ ID NO: 349364 - DNA, 534 bp, Homo sapiens
  misc_feature: GZ8MTXP02IZNHC.45.37.D04.1.454.CMB.2.raw
  modified_base (339)..(339): a, c, t, g, unknown or other
  misc_feature (339)..(339): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (445)..(445): a, c, t, g, unknown or other
  misc_feature (445)..(445): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaggtctcctgcaaggcttctggctacaccttcaccggcgactatcctccactggtgcgacaggcccctggacaagggcttgagtggatgggatggatcaaccccctaanatggtgcacaaactntgcanagaagtttcagggcaggtcaccagtagaccgagggacacgtccatacgagcacacgcctacgagtggagctagagcagactgaacngtctacgacacgacggtacctatttactactggttgaacggtaggtaacgttcggtttaaccgggtcggtcgtttcggtttttacccgg

SEQ ID NO: 349365 - DNA, 639 bp, Homo sapiens
  misc_feature: GZ8MTXP02HN8IO.45.37.D04.1.454.CMB.2.raw
  modified_base (253)..(253): a, c, t, g, unknown or other
  misc_feature (253)..(253): n is a, c, g, or t
tcagacgcgatcgacacgaccggtgctcgatttagtagcatactgttgggtttgggggagcatcacccagcaaccacatctgtcctccagagaatcccctgagagctccgttcctcaccatggactggacctggaggatcctcttcttggtggcagcagccacaagagcccactcccaggtgcagctggtgcagtctggggctggaggtgaggaagccgtggggcctcagtgaaggtctcctgcaaggcttcnggctacaccttcaccggcgactatcctccacgtgggtgcgacgacggtcccctggaacgaaggggtcttggaggtggagtggggatagggataccgaaaccccctaacgaagtggtacggactaaacaaactgtacgacaacgaagtaagtttcgagggacgtagggtaccaaccgatacggaaccgagggaaccacgtccaactcgacgcaaaccacgaccctaacgagttcgggaagtaccgaggaacgacgtaacggtacgtaacgacgtaactccgtaacgaccggtaaccgaccggtaccttaaattttactaacgttcgtaggaaccggtaggtacgtttacgggttaccgggttcggtcgttttacggtttttacccgg

SEQ ID NO: 349366 - DNA, 636 bp, Homo sapiens
  misc_feature: GZ8MTXP02GHPT5.45.37.D04.1.454.CMB.2.raw
  modified_base (381)..(381): a, c, t, g, unknown or other
  misc_feature (381)..(381): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatctccactgggtgcacgacggcccctaggaccgaagggccttggagtggagtggggatggactaccgaaaccccctaacaacgtggtacggacaaacaaaacgttanacgacaacgaagtaagttacgagggacgaaggtaccaacgagtacgaaccgaacgggacaccgtacacacacgaccaacgaccgacctaacgtagtacggacggtacgtacgacgacgtaacgaactacgaactacgtacgtacggaaccgaaccgtaccggtacttaacgtttacgttacgtcggtacggtaacggtaaggttacggtttacgggtttaccgggttcggttaccggttttacgggttttacccg

SEQ ID NO: 349367 - DNA, 613 bp, Homo sapiens
  misc_feature: GZ8MTXP02G0MNX.45.37.D04.1.454.CMB.2.raw
  modified_base (477)..(477): a, c, t, g, unknown or other
  misc_feature (477)..(477): n is a, c, g, or t
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagccccactcccaggtgcagctggtgcagtcgtggggctgaggtgaggaagccgtggggcctcagtgaaggtctcctgcaggcttctggctacaccttcaccggcgactatctccacgtgggtgcgacacggcccctggacgaagggcttggaggtgggagtggggatggggactaccaaaccctaacgaagtgggtacgacaacaaaacttatgacaacgaagtaagtttccgaaggggctaacgggggtccaaccgtacgtagacccggaagggtaccaaccggtcacgtacgacgacacgagaccctanagtaggacgctaggacgcagacgtagactacgtcacgaccgacgacggaccttatttaacgtacgtaggtcgtacggtaacggtagtttaccggggtttacggtcggttcgtttccgggttttacgttttacgggg

SEQ ID NO: 349368 - DNA, 611 bp, Homo sapiens
  misc_feature: GZ8MTXP02JEX46.45.37.D04.1.454.CMB.2.raw
  modified_base (351)..(351): a, c, t, g, unknown or other
  misc_feature (351)..(351): n is a, c, g, or t
  modified_base (372)..(372): a, c, t, g, unknown or other
  misc_feature (372)..(372): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcagtgaaggtctcctgcaggcttcgtggctacaccttcgaccggcgactactcctccacgtgggtcgcgacgacggccccgtggacgaagggcttgagtggagtgggatggatacaacccctaanaagtggtaggacaacaaactntcgacacgaagtaagtttcgagggcgtaacgggtcaaccgagtacggaccgaagggacaccgtaccgactacgacgacacgacgacctaacgtagtacggtacgcgtagacgacgaggactaggactacgtacgtacggaaccgacgtaaccggtaccttaattttacgtacgtacggttacgccggtaaggtacgtttacgggttaccgggtcggttaccgtttcgggtttttacccg

SEQ ID NO: 349369 - DNA, 669 bp, Homo sapiens
  misc_feature: GZ8MTXP02HKGCS.45.37.D04.1.454.CMB.2.raw
  modified_base (246)..(246): a, c, t, g, unknown or other
  misc_feature (246)..(246): n is a, c, g, or t
  modified_base (527)..(527): a, c, t, g, unknown or other
  misc_feature (527)..(527): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaacgccgtcggggccctagtgtaggacgtctcgngacgacgtcttcgcgtacctacctcctaccggaccgacgtactctcctcgtacggtggacgacgaccggacccgtccggtacggacgggtacggtcgtaggtagggtaggtaggtaggtagtacgtactaaaccccgtaaactaaacgtacggtacggtacgaacaaactaaagttagcgtacgaacgtaaggttacgttacgggacggacggtacgaccagtacgaccgacggacgaccgtacgacgtacacgacacacgacctaccagtagtagacgtnaggcacgaagtcgacgactacgtcgaaccgaccgaccgtaccgtaactttacgtttaacgtacgttcggaccgttagggtaaggttcggtttacccggggttacggttacgtttaccgggtttccgtttttacggtaccggg

SEQ ID NO: 349370 - DNA, 709 bp, Homo sapiens
  misc_feature: GZ8MTXP02FLATQ.45.37.D04.1.454.CMB.2.raw
  modified_base (258)..(258): a, c, t, g, unknown or other
  misc_feature (258)..(258): n is a, c, g, or t
  modified_base (289)..(289): a, c, t, g, unknown or other
  misc_feature (289)..(289): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctgagtgaaggtctcgtgcgaggtcttcgnggctacaccttcgaccggacgactacgtccnccgagtgggtcgcgacgaccggtccccgtaggaacgtagggtctaggaggtgggtaggtaggggtagtacgggtactaacccccgaaaacccgttaaacgtaaacgttggggtacggaccaaaacgtaactacgtaggaaccaacgtaaaggtttaacgttcggaacggggacgtacggggtaccaaccgtagacggaacccggaacggacctacccggtacacgtacgaacgccaacgacgtacccctaagtacggtacggggatccggaagacgacgtaacggactaagacccgtaagtcgaaccggaaccggacccggtaaacggtactttaaacgtttaacgtcgtacggtaacggtaaccgggtaaggttacggtttaccgggtttacggggtccggttcggttttttacccggg

SEQ ID NO: 349371 - DNA, 594 bp, Homo sapiens
  misc_feature: GZ8MTXP02HU73H.45.37.D04.1.454.CMB.2.raw
  modified_base (379)..(379): a, c, t, g, unknown or other
  misc_feature (379)..(379): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcagtgaaggtctcctgcaggcttcgtggctacaccttcaccggcgactatcctccacgtggggtgcgaccgacggcccccgtggacgaagggcttggaggtggagtggggatggataccaacccctaaacgaatgggtacggacaacgaaactntgacacagtaagttcgagggcagggtcaccagtagaccgagggacacgtcactcagccacacgacctacgagtagggacgcgtaggacgacgaggactaggactactcgtacgacgacggtaccggccttaaattttacgtacgttggtcggtaacggtaacgggtaagtttccggggttttaccgggtcggttccggtttcgggtttttcccgg

SEQ ID NO: 349372 - DNA, 629 bp, Homo sapiens
  misc_feature: GZ8MTXP02JTOHQ.45.37.D04.1.454.CMB.2.raw
  modified_base (376)..(376): a, c, t, g, unknown or other
  misc_feature (376)..(376): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagctggggcctcagtgaggtctctgcaggctctggctacaccttcgaccggcgactactcctccacgtgggtgccgacgacggccccctgggaacgaaggggccttaggagtggagtgggatggactaccaacccctaacagtgggtacgacaacaaacttgngactaacgagtaacgttcgagggtcgaggggtccaacgagtacgaccgaagggaccaccggtaccagcgacgacgaccgagtacccctaagtagtacgggacgtacctaggacgacgaacgaccgttacgaactacgttacgacgaacccggtaccgtaaccgggtaccttaaggttttaactacgttcggtacggaacggtaaggttacgtttacggggtttaaccggtcggttcgtttcggtttttaccgg

SEQ ID NO: 349373 - DNA, 622 bp, Homo sapiens
  misc_feature: GZ8MTXP02H338B.45.37.D04.1.454.CMB.2.raw
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
  modified_base (274)..(274): a, c, t, g, unknown or other
  misc_feature (274)..(274): n is a, c, g, or t
  modified_base (377)..(377): a, c, t, g, unknown or other
  misc_feature (377)..(377): n is a, c, g, or t
  modified_base (476)..(476): a, c, t, g, unknown or other
  misc_feature (476)..(476): n is a, c, g, or t
  modified_base (590)..(590): a, c, t, g, unknown or other
  misc_feature (590)..(590): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctgtaggatcctcttcttggtggcagcagccacaagagcccactcccaggtgcagctggtgcagtcgtgggctggaggtgaggaagcgtgggcctcgagtgaggtctctgcaaggcttcgnggctacnccttcaccggcgactacnctcacgtgggtcgcgacgacggcccctggaccgaagggcttggagtggagtgggatcggatacaaacctaacgaagtggtagacaacaaagtactcgaccaanacggttaaagttcgaaggggtcaaggggtacccaaccgagtacggaccgaagggacctacgtacagtacaacgcaacgacgaccttaacagtcggaacncgtagaagaccgaaggacctagaactaacgtcgaacggaaccgaacgtaccgggtaccttaaagtttacgtaacgtggtacggtacggaaggttacgttaacgggtttcccggnggtttccggtttcggtttttaccgtttacggg

SEQ ID NO: 349374 - DNA, 589 bp, Homo sapiens
  misc_feature: GZ8MTXP02J0UUJ.45.37.D04.1.454.CMB.2.raw
  modified_base (371)..(371): a, c, t, g, unknown or other
  misc_feature (371)..(371): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaggtctctgcaaggcttctggctacaccttcgacccggcgactatcctccgactgggtgcgacacggcccctggacaagggcttggagtggagtggggatggactaccaaaccccctaaagagtgggtacggacaacaaactntgacaacgagtaagtttcgaggggcacggggtcaccatcgaccgagggacacgtccatcagcacgacgacctacgatgggacgcgtagacggactacggactaggaactacgtacgtacggaaccgaccgaaccggtaccctaattttacgttaccgtggtacggaacggtacggtacgttcggtttaccggtcggttacgtttcggtttttacccgg

SEQ ID NO: 349375 - DNA, 602 bp, Homo sapiens
  misc_feature: GZ8MTXP02GKY4B.45.37.D04.1.454.CMB.2.raw
  modified_base (378)..(378): a, c, t, g, unknown or other
  misc_feature (378)..(378): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcagtgaggtctcctgcaaggcttctggctacaccttcaccggcgactactcctccacgtgggtgcgacgacggccccctaggaccgaaggggtcttggaggtggagtgggatggactaccaacccctaacgaagtggtacggacaacaaaactntcgacaacgaagtaacgtttcgaggggcaaggggtcaaccgagtacgaaccgagggaccaccgtaccaatcgacgcaacgacgacctaacagtaggacgcgtacgagcgaagactagaactacgtcgacgaccgaaccgtaccggtacccttaattttacgtaacgttggtacgaacggtaaggtacgtttacggttaccggtggtccgtttacggttttaccg

SEQ ID NO: 349376 - DNA, 676 bp, Homo sapiens
  misc_feature: GZ8MTXP02GLBIH.45.37.D04.1.454.CMB.2.raw
  modified_base (229)..(229): a, c, t, g, unknown or other
  misc_feature (229)..(229): n is a, c, g, or t
  modified_base (251)..(251): a, c, t, g, unknown or other
  misc_feature (251)..(251): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtggaggaagccgtgggcctnagtgaggtctctgcaggctcgnggctacaccttcgaccggcgtactactcctccgtacgtcgggtcgacgaccgacggccccgtaggaacgaagggtccttggaggtggaggtgggactggaactaccgaaaccccccgttaaagaacgttggggtacggaccaaacaaaacttcgtcgaacaaacgtaaagttaacgtttacggagggtacggaacggtaccaaccgtacgtacgaccggaaggaccaccgtaccacgtacacgacaaccacggaccttaacgagagggacgtagaccgaggaccaaagacgtacgaactacgtaccgtacggaaacggaccgacggtaacccttaagttttaactaacgtcggttacggaaccggtaaaggtacggtttacgggtttaccggggttcgttcccgggtttcggtttttaacccggg

SEQ ID NO: 349377 - DNA, 586 bp, Homo sapiens
  misc_feature: GZ8MTXP02I1L9I.45.37.D04.1.454.CMB.2.raw
  modified_base (362)..(362): a, c, t, g, unknown or other
  misc_feature (362)..(362): n is a, c, g, or t
  modified_base (384)..(384): a, c, t, g, unknown or other
  misc_feature (384)..(384): n is a, c, g, or t
tcagacgcgatcgacacgaccggtgctcgatttagtagcatactgttggggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctgggggctggaggtgaggaagccgtgggggcctcagtgaaggtctcctgcaggcttctggctacaccttcaccggcgactatcctccacgtggggtcgcgacacgggcccccctggaccgaaggggtcttaggaggtgggagtggggatgggactacaaaccctaanagtggtggacaacaaaaccgtntcgacaacgagtaagtttccgaggggcaggggtacaccgtagtacgaccgaagggaccacgtcccatccaagcaactagacctacgagtacggacgccgtagacgcctaggactaggactatcgagaccgacacggtcctaatttactacgtcggtgacgaagtacgttacggttacggtgtactttacgtttcctttaggg

SEQ ID NO: 349378 - DNA, 554 bp, Homo sapiens
  misc_feature: GZ8MTXP02H4G36.45.37.D04.1.454.CMB.2.raw
  modified_base (227)..(227): a, c, t, g, unknown or other
  misc_feature (227)..(227): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
  modified_base (406)..(406): a, c, t, g, unknown or other
  misc_feature (406)..(406): n is a, c, g, or t
tcagacgcgatcgacacgaccggtgctcgatttagtagcatactgttgggtttggggcatcacccagcaaccacatctgtcctctagagaatccccctgagagctccgttcctcaccatggactggacctggaggatcctcttcttggtggcagcagccacaagagccccactccccaggtgcagctggtgcagtcgtggggctggaggtgaggaagcgtgggcctnagtgaggtctctgcaggcttnggctacnctcaccggcgactanctccacgtgggtcgcgacgacggccccctggacgaaggtcttggagtggagtgggataggatacaaacctaaccgaagtggtcggacaaacgaaaactatgacaacgagtaagtttcgagggcaagggtccactanacgacgaggacacgtcatacagcaacgcgactacagtggagcgagagacgagactagactagtcgagacgaactcggacctaagtttactacgcgttgacggtaaggtattcggtttaccggtgtccgtttcggttttcctttacggg

SEQ ID NO: 349379 - DNA, 661 bp, Homo sapiens
  misc_feature: GZ8MTXP02HPQLZ.45.37.D04.1.454.CMB.2.raw
  modified_base (253)..(253): a, c, t, g, unknown or other
  misc_feature (253)..(253): n is a, c, g, or t
  modified_base (292)..(292): a, c, t, g, unknown or other
  misc_feature (292)..(292): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaggtctcctgcgaagcttcnggctacacctcaccggcactatctccacgtggtgcgacncggccccgtggacagggtcttggagtggagtgggatggactaccaaacccccctaaagaagtcgggtacggacaaaccgaaaacttacgtcgacaaacgtaaggttaaacggtttcgaagggggtaccgtaacggggtccaaacccgtaagtacggaacccgaaggggaacctaccggtaccaacgtacgacgaccaaacgaccggtaccctaacgtaacggtagggaacgtccgaggaacgaccgaaggacccttagaaccgtataccggtacgaaacggtaccgaccggtacttaaacgttttactacgttagtacggaacgtaggtactttacgggttaccggtcggttccgtttaggttttcccg

SEQ ID NO: 349380 - DNA, 700 bp, Homo sapiens
  misc_feature: GZ8MTXP02HL9UX.45.37.D04.1.454.CMB.2.raw
  modified_base (256)..(256): a, c, t, g, unknown or other
  misc_feature (256)..(256): n is a, c, g, or t
  modified_base (283)..(283): a, c, t, g, unknown or other
  misc_feature (283)..(283): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctgagtgaaggtctcctgcaaggcttcgnggctacaccttcaccggcgactatccnccacgtgggtcgcgacgacggcccctaggacagggcttggaggtggagtggggatggactaccccaaaccctaagaagtggtaggaccaacaactagtcggacacgtaagtacgtttacgaggggtaccgagggttaccaaccgtacgtacggaacccgagggacccctaaccgtacccaagtacccgaacgaccgaaccacggtacccccgtaaagtagtacgggggaaactcccgttaggaaccggaccgaacggtaaccgttaggaaaccacgtttaccggacggtaaacccggaacccgtaccgggtaacctttaaacgttttaacgttaaccggttggtaacggtaccgggttaacgggttacgtttaaccgggggtttaacccggttacgggtttcccgtttttaccgggg

SEQ ID NO: 349381 - DNA, 677 bp, Homo sapiens
  misc_feature: GZ8MTXP02HTCFR.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatcctccacgtgggtgcgacgacggcccctggacgaagggcttggagtggagtggggatggataccaaaccccctaacgaagtgggtacggacaaacctaaaactgtacgaccaaacgtaaggtaacggtttacgaagggggtaccgagggggttaccaaccgtagtacggaacccggaacggggaaccaccggttaccaacgtccgaacggcccaaacaccggtaccctaactagtagggacgaccgtagacgacgaacggacgtaggaccgataccgtacggaaccgaccgaaccggtaccttaaacttttacgttaaccgtggtacggtaacggtaagggttaacgtttaccggggtttaaccgggtttcggtacccggtttttcgggtttttaccccgg

SEQ ID NO: 349382 - DNA, 543 bp, Homo sapiens
  misc_feature: GZ8MTXP02J1FH5.45.37.D04.1.454.CMB.2.raw
  modified_base (444)..(444): a, c, t, g, unknown or other
  misc_feature (444)..(444): n is a, c, g, or t
tcagacgcgatcgacacgaccggtgctcgattttagtagcatactgttgggtttgggggcatcacccagcaaccacatctgtcctctagagaatccccctgagagctccgttcctcaccatggactggacctggaggatcctcttcttggtggcagcagccacaagagccccactccccaggtgcagctggtgcagtctgggggctgaggtgaggaagcctgggggcctcagtgaaggtctcctgcaggcttctggctacaccttcaccggcgactatctccactggggtgcgacaggcccctggacaagggcttgagtggagtggggatgggatcgaaccctaacaagtggtggcacaaacgtatgcaacagaagtttcgagggacaggggtacaccgagtcgaccgagggacacgtccatcagcacacgacctacagtggancgtgagcagactgacatcgagacgacgaccgtaccgtatttactactgtagacggtaagacgttcggttacggtggtcgtttcggtttacgttttacgg

SEQ ID NO: 349383 - DNA, 688 bp, Homo sapiens
  misc_feature: GZ8MTXP02FMEXN.45.37.D04.1.454.CMB.2.raw
  modified_base (362)..(362): a, c, t, g, unknown or other
  misc_feature (362)..(362): n is a, c, g, or t
  modified_base (382)..(382): a, c, t, g, unknown or other
  misc_feature (382)..(382): n is a, c, g, or t
  modified_base (484)..(484): a, c, t, g, unknown or other
  misc_feature (484)..(484): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggagcgtgggcctcgagtgaggtctcgtgacgaggcttcgtggctaccaccttccgaccggcgactatcctccacgtgggtcgcgacgaccggcccctaggaacgagggtcttaggaggtggagtgggagtggactaccgaaacccctaanagtgggtacgacaagaactntcgacaagagtaagttcggagggacgtagggtccaaccgtagtacgaaccgaagggacctacccggtacacgtacgaacgaccaacgaaccgacccgttaanaacggttacgggaacgtccgtaaggacggactaacggactacgaaccgtagttccgaacgaacccggaaccgtaaccgggtaccctttaaagtttttacccgtaaaccggtgggttaacgggtaaccgggtaagggttttaacggtttaccgggggttttaacccgggtcggttttaccggttttacggggttttttaacccgg

SEQ ID NO: 349384 - DNA, 536 bp, Homo sapiens
  misc_feature: GZ8MTXP02FWBLR.45.37.D04.1.454.CMB.2.raw
  modified_base (365)..(365): a, c, t, g, unknown or other
  misc_feature (365)..(365): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctggggcctcagtgaaggtctcctgcaaggcttctggctacaccttcaccggcgactatctccactgggtgcgacacggccccctggacaagggcttggagtggagtgggatggatccaaccccctaacaatggtggcaacaaaactntgcaacagaagtttcgaggggcagggtcaccatgaccgagggacacgtccatcagcacgacgacctacgagtgggaagctaggagacacgactgacagtcgtacgacgacgaccggacctatttactacgtgtgcgaggtattcggtttaccggtggtcgttggttttccg

SEQ ID NO: 349385 - DNA, 664 bp, Homo sapiens
  misc_feature: GZ8MTXP02F5GYA.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcgagtgaggtctctgcaggcttctggctacaccttcgaccggcgactactctccacgtgggtgcgacgacggcccctggacgagggcttggagtggagtgggatggactacaaacccctaacgagtggtacgacaacaaactgtacgacaagtagtaagttcgaggggctacgggtcaaccgtagtacgaaccgaggggaccaccgtaccaactacgacgaccaaccgacgacctaacgaggttaggacgtaccgtaggaacgaccgaaggaccgttaggacctaacgttaccgtaacggaacccgaaaccggacccgggtaaaccctttaaagtttttaaccgttaaccgttgggttacggaacggttaacggtacggttttaccggggttttaacccggggtcggtttacggttttaccgggtttttttaccccgg

SEQ ID NO: 349386 - DNA, 677 bp, Homo sapiens
  misc_feature: GZ8MTXP02FP0DT.45.37.D04.1.454.CMB.2.raw
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagccccactccccaggtgcagctggtgcagtctggggctgaggtgaggagccgtggggcctcagtgaggtctcctgcaggctctggctacaccttcaccggcgactatctccacgtgggtgcgacacgggccccctggacgaagggcttgaggtggagtggggatagggactaccgaaccctaaaccgaagtcggtaggaccaactaaaaccgtatcgacaactaaggtaaacggtttccgaaggggaccgtaaacggggttaccaaaccgtacgtacggaacccgaaggggaacccgtaccgtacccaacgttacacggaccaccaaccggaccctaacacggttagggacgtaccgagacgacgacggtacacggaacaagtcgaacggacccgtacgaaccggtaccttaagttttaacttaccggttagtacggtaccggtaagggtaacgtttacggtttacccggggtggtttaccggtttacggtttttccgtttttaaccgggg

SEQ ID NO: 349387 - DNA, 639 bp, Homo sapiens
  misc_feature: GZ8MTXP02JNP8V.45.37.D04.1.454.CMB.2.raw
  modified_base (262)..(262): a, c, t, g, unknown or other
  misc_feature (262)..(262): n is a, c, g, or t
  modified_base (293)..(293): a, c, t, g, unknown or other
  misc_feature (293)..(293): n is a, c, g, or t
  modified_base (297)..(297): a, c, t, g, unknown or other
  misc_feature (297)..(297): n is a, c, g, or t
  modified_base (348)..(348): a, c, t, g, unknown or other
  misc_feature (348)..(348): n is a, c, g, or t
  modified_base (371)..(371): a, c, t, g, unknown or other
  misc_feature (371)..(371): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcgagtgaaggtctcctgcaaggcttcgtggctacnccttcgaccggcgactatcctccagtgggtncganacggccagtggacagggcttgaggtgatgggatggatacccgaaccctaanaagtggtacggacaactaacgtntggaccaacgaagtaacgtttacgaggggacgtagggtaccaccgtagtaccgaaccgaagggacctaccggtaccaactaccgaacgaccgacgacgtacctaagagggtacggaacgtcggtacggaacgtaccgaacggtacgtacgaactacgttacgaaacggaaccgaaccgtacgttaacctttaagtttaacgtcgtaggtaacggtacggttaacggttacggtttaccgggttaaccggttcggttaccggttttcgg

SEQ ID NO: 349388 - DNA, 525 bp, Homo sapiens
  misc_feature: GZ8MTXP02IXKG0.45.37.D04.1.454.CMB.2.raw
  modified_base (285)..(285): a, c, t, g, unknown or other
  misc_feature (285)..(285): n is a, c, g, or t
  modified_base (353)..(353): a, c, t, g, unknown or other
  misc_feature (353)..(353): n is a, c, g, or t
  modified_base (385)..(385): a, c, t, g, unknown or other
  misc_feature (385)..(385): n is a, c, g, or t
  modified_base (395)..(395): a, c, t, g, unknown or other
  misc_feature (395)..(395): n is a, c, g, or t
  modified_base (442)..(442): a, c, t, g, unknown or other
  misc_feature (442)..(442): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaggtctctgcaaggcttctggctacaccttcaccggcgactatcctccactgggtncgacacggcccctggacagggcttgagtggatgggatggatcaacccctacatggtgacaacaaactntgacacgagtaagttcgagggcagggtcacangacgaggacncgtcatcagcacacgacctacgagtggagctagagacagactgaacngtctacgacgacgaccggtactagtttactacgtgtacgaacgaggtacgttcggttaccggtcggtcgtttcggttttaccg

SEQ ID NO: 349389 - DNA, 553 bp, Homo sapiens
  misc_feature: GZ8MTXP02J1S9V.45.37.D04.1.454.CMB.2.raw
tcagacgcgatcgacacgaccggtgctcgattttagtagcatactgttgggtttgggggcatcacccagcaaccacatctgtcctctagagaatccccctgagagctccgttcctcaccatggactggacctggaggatcctcttcttggtggcagcagccacaagagccccactccccaggtgcagctggtgcagtctgggggctgaggtgaggaagcctgggggcctcagtgaaggtctcctgcaaggcttctggctacaccttcaccggcgactatcctccactgggtgcgacaggccccctggacaagggcttgagtggatggggatggatcaaaccctaacaagtggtggacacaaactatgcacagaagtttcgagggcagggtcaccgatacgacgacggacacgtccatcagacacacgacctaccagtaggagcgtagacgcgaacgacgtaggacatcgtagacgacgaccggacccgtatttattaccccctgtcgacgaaggtagtacggttacggtcggtcgttcggtttcgttttcggg

SEQ ID NO: 349390 - DNA, 854 bp, Homo sapiens
  misc_feature: GZ8MTXP02F9FR4.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctccgtgacgacgtcttcgtcggtacctaccctaccttaccggaccggtacgtaacctacgtcccctaccgtacgggttcggggtacggaccgaccgggaccccggtccccggtacgggaaccggtaacgggttcggttagggtacgggtagggtaggggtagggtacggtaacggtaacctaaaccccgtaaaacccccgtaaacggtaagggttacggggtaaccggtaaccaaaaaccgttaaacgttacggtaccgaaaccgtaaacggttaaacgggtttaacggttacggggaacggggtaccgggtaaaccggggttacccaaacggttagaacccgggaacccgggaaaggggaacccctacccggttacaaccgtacggaaccaaccgaccggtaacccgtaaacccgtagtacgggtagggaccggttacgaacgggacgaacggacggttaaacctcgaaacttccgttacggaaccggaaacccgtaccggtaaacccgttactttaaagttttaccgtagggtcgtaaccggggtaaggttaacggtttacgtttaccgggggttaccggttcggtttaccggtttcggttttttaacccggg

SEQ ID NO: 349391 - DNA, 619 bp, Homo sapiens
  misc_feature: GZ8MTXP02F6GVA.45.37.D04.1.454.CMB.2.raw
  modified_base (358)..(358): a, c, t, g, unknown or other
  misc_feature (358)..(358): n is a, c, g, or t
  modified_base (378)..(378): a, c, t, g, unknown or other
  misc_feature (378)..(378): n is a, c, g, or t
  modified_base (512)..(512): a, c, t, g, unknown or other
  misc_feature (512)..(512): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaacggtctcctgcaaggcttctggctacaccttcgaccggcgactatcctccacgtgggtcgcgacgacggccccgtaggaccgaaggggcttggaggtggagtgggatggactacaaccccctaanagtggtgacaactaaaactntcgacaacgagtaagtttcgacggggctaagggtccaaaccagtacgaaccggtaagggaaccacgtaccagtacacgacaaacacgtaccctacgagtcgggagtccgagacggacaacggactaggtaaacncgtacgtacggaaccgaccgtaaccgtacgttaactttacgtaacgtggtacggtaaggtaacggtacgtttacggtttacggtcggtttaccgtttcggttttacg

SEQ ID NO: 349392 - DNA, 507 bp, Homo sapiens
  misc_feature: GZ8MTXP02FXLRK.45.37.D04.1.454.CMB.2.raw
  modified_base (289)..(289): a, c, t, g, unknown or other
  misc_feature (289)..(289): n is a, c, g, or t
  modified_base (340)..(340): a, c, t, g, unknown or other
  misc_feature (340)..(340): n is a, c, g, or t
  modified_base (357)..(357): a, c, t, g, unknown or other
  misc_feature (357)..(357): n is a, c, g, or t
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtncgacacggcccctggacaagggctgagtggatgggatggatccaaccctanaatggtggacacaactngcacagaagtttcagggcaggtcacatcgacagggacacgtcatcagcacagccctantggatcngagcaagctagactatcgtgacgacacggacctatttactactgtaacgcgtaaggacttcggtttaccggtggtacgttttcgg

SEQ ID NO: 349393 - DNA, 604 bp, Homo sapiens
  misc_feature: GZ8MTXP02JMA11.45.37.D04.1.454.CMB.2.raw
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactccccaggtgcagctggtgcagtctgggggctggaggtgaggaagccgtgggggcctcgagtgaaggtctcctgcaaggcttctggctacaccttcaccggcgactatctccactgggtgcgacacgggccccctggaccaagggcttggagtggagtggggatgggataccgaaacccctaacgaagtgggtgaccaacgaaaacttacgtgacaacaaggtaaacgtttcgaacggggcaggggtacaccgatacgaccgaggggacctacgtccagtcgagacactacgcctacagtcggacgactgacgacagacagacctatcgtacggaacgcgacggtacccttaatttacgttaaccgtgtcggacgtaaggtacgtttcggtttaaccgggtcggtacgtttcgggtttccctttttaacgggg

SEQ ID NO: 349394 - DNA, 589 bp, Homo sapiens
  misc_feature: GZ8MTXP02HNHIY.45.37.D04.1.454.CMB.2.raw
  modified_base (378)..(378): a, c, t, g, unknown or other
  misc_feature (378)..(378): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctcctgcaaggtcttctggctacaccttcaccggcgactactcctccacgtgggtgcgacgacggcccctggacgaagggcttggagtggagtgggatggactaccaaaccccctaacaagtgggtagacaacgaaactntcgacacgagtaacgtttcgagggcacggggtcaaccgatacggaacccgagggacacgtcacgtcacgcacacgacctaactagtggacgtccgtaggacgacgaacgacgagactacgtcgtacgaccgacgaaacggtccttaagtttacttacgtcgtgcggtaaggtacgttacggtttacgggtcggtcgtttcggtttttccgg

SEQ ID NO: 349395 - DNA, 605 bp, Homo sapiens
  misc_feature: GZ8MTXP02IUF49.45.37.D04.1.454.CMB.2.raw
  modified_base (342)..(342): a, c, t, g, unknown or other
  misc_feature (342)..(342): n is a, c, g, or t
  modified_base (431)..(431): a, c, t, g, unknown or other
  misc_feature (431)..(431): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagcctggggcctcagtgaggtctcctgcaaggcttctggctacaccttcaccggcgactatctccactgggtgcgacgacggccccctggacaagggcttggagtggatgggatggatcaacccctanatggtagcaacaaactgtgacacagaagttcaagggcagggtcacatcgacagggacacgtcatcagcaacacgacctacgatacgganccgtagacgacaggaactggaaccagttaccgtacggaacccgaaaccgaaccgggtacccttaaagtttttacgttaaaccgttcggttaggaacccgggtaaagggtaacgttttaccggggtttaaccccggggtagggttacccggttttcgggtttttttaaccccggg

SEQ ID NO: 349396 - DNA, 516 bp, Homo sapiens
  misc_feature: GZ8MTXP02GDGB6.45.37.D04.1.454.CMB.2.raw
  modified_base (290)..(290): a, c, t, g, unknown or other
  misc_feature (290)..(290): n is a, c, g, or t
  modified_base (342)..(342): a, c, t, g, unknown or other
  misc_feature (342)..(342): n is a, c, g, or t
  modified_base (430)..(430): a, c, t, g, unknown or other
  misc_feature (430)..(430): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatctccactgggtncgacaggcccctggacaagggcttgagtggatgggatggatccaaccctaanatggtgacacactatgacacagaagtttcgagggcgagggtacacgatgaccgagggacacgtcatcagacacacgcctacagtggancgtgagcagactgacatcgtagacgacacggactatttactacgtgtcgcggagtacgttcggtttaccggtggtacgttttcggg

SEQ ID NO: 349397 - DNA, 534 bp, Homo sapiens
  misc_feature: GZ8MTXP02GRNPV.45.37.D04.1.454.CMB.2.raw
  modified_base (312)..(312): a, c, t, g, unknown or other
  misc_feature (312)..(312): n is a, c, g, or t
  modified_base (359)..(359): a, c, t, g, unknown or other
  misc_feature (359)..(359): n is a, c, g, or t
  modified_base (423)..(423): a, c, t, g, unknown or other
  misc_feature (423)..(423): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgtttagacagctccaacaataagaactactagcttggtaccagcagaaaccaggtcagcctactaagctgctcatttacnggcatcgtacccgggaatccggggtcccctgacctattcagtcggcngggcgggtcgtgggactaggtactttcacctctcaaccatacagcagccctgcgaggcagaaangtgtggtactagtttatgcttgtcagataattactttatatacttcctccgtacttccgaccgtaggaccaagttcgaagttactacgaaaactacgtagtacggtctacg

SEQ ID NO: 349398 - DNA, 709 bp, Homo sapiens
  misc_feature: GZ8MTXP02IKG7P.45.37.D04.1.454.CMB.2.raw
  modified_base (247)..(247): a, c, t, g, unknown or other
  misc_feature (247)..(247): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtgggctcagtgaggtctctgcaggcttcnggctacaccttcgaccggcgactatcctccgacgtgggtgccgacgaccggcccctagggacgaagggtcttggaggtggagtgggagtggaactaccaaacccctaaacgagtggtacgacaaccaaaactgtacgacaacgtaagttacgtttcgaacggggtacgtaacgggtcaaaccgtagtacggaacccgaaggggacctacccgtaccgaacgtaccgagaccgaaaccaccggtacctaacgtaggtcgggacgtcgtacggacgacgaacggtaacgttacgaaaccgtacgttaccgtaaacggaacccgggaaaccgtaaacccgggttaaccgttaaaactttttaacggtttaaaccgtggttaccggtaacgggttaaacggttacgtttaccgggggtttttaaccgggtccggttttccggttttacggtttttttaaccccggg

SEQ ID NO: 349399 - DNA, 612 bp, Homo sapiens
  misc_feature: GZ8MTXP02G8TJM.45.37.D04.1.454.CMB.2.raw
  modified_base (229)..(229): a, c, t, g, unknown or other
  misc_feature (229)..(229): n is a, c, g, or t
  modified_base (505)..(505): a, c, t, g, unknown or other
  misc_feature (505)..(505): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctnagtgaaggtctctgcaaggcttctggctacaccttcaccggcgactatctccactgggtgcgacaggcccctggacaagggcttgagtggatggggatgggatacccaaaccctaacgaagtgggtacggtacaactaacgtatacgacaaccgtagaaagttttcgaggggtaccaggggttacccaccgaagtacgaaccgacggggaccaaccggtccctaagccacggaccaaccacggacccttaacacgttagggagaccgtaggacganacggactacggacattacgaggacaccgtaacggaccttattttaacgtaaccgttggtcgacggacggtacgttacggtttaccggggttcgtacgtttttccggg

SEQ ID NO: 349400 - DNA, 667 bp, Homo sapiens
  misc_feature: GZ8MTXP02GPG68.45.37.D04.1.454.CMB.2.raw
  modified_base (229)..(229): a, c, t, g, unknown or other
  misc_feature (229)..(229): n is a, c, g, or t
  modified_base (477)..(477): a, c, t, g, unknown or other
  misc_feature (477)..(477): n is a, c, g, or t
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagcccactccccaggtgcagctggtgcagtctggggctgaggtgaggaagccgtgggggcctnagtgaggtctcctgcaaggcttctggctacaccttcgaccggcgactatctccacgtgggtgcgacacgggccccctggacgaaggggcttggaggtggagtggggatgggataccaaacctaaccaagtggtaggacaacgaaaactatcgacaacgaaggtaaagtttccgaaggggtccgaaggggtaccaacccgtagtcgaaccgaggggaccacgtacccatccgagacacaagccctaaanacgtggacgcgtagacgacacgtaacgtcggaacacgttacgacggaacccggaaccgtaccgggtacctttaaacgttttaaacgttaaccgttcgggtagtacccgggtaaaggggttacgttttacggggttttaaccggggtacggtttaccggtttacggggtttttcccttttttaaccggggg

SEQ ID NO: 349401 - DNA, 612 bp, Homo sapiens
  misc_feature: GZ8MTXP02G1EX3.45.37.D04.1.454.CMB.2.raw
  modified_base (362)..(362): a, c, t, g, unknown or other
  misc_feature (362)..(362): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtggggcctcgagtgaggtctcctgcgaaggtcttcgtggcctacaccttcgaccggcgactactcctaccgacgtggtgccgacgacggcccctaggacgaaggtcttggaggtggagtggatggactacgaaccccctaanagtggcgacaacaactgtcgacaacgtaagtaacgtttcgagggtacgacgggtaccaaccgtagacggaccgaagggaccaccgtaccacgtacacgaccaacgacgtaccgtacgtagtcggaacgcgtagagtaccgagaacgtacgaactacgtcgtaacggaccgaccgaccgttaccttatttacgtacgtgtagaacggtagtacggtttcggttaccggtcggtcgtttacggttttaccgg

SEQ ID NO: 349402 - DNA, 583 bp, Homo sapiens
  misc_feature: GZ8MTXP02HG6MD.45.37.D04.1.454.CMB.2.raw
  modified_base (384)..(384): a, c, t, g, unknown or other
  misc_feature (384)..(384): n is a, c, g, or t
  modified_base (458)..(458): a, c, t, g, unknown or other
  misc_feature (458)..(458): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttcgtggctacgacccttcgaccggcgactatcctccacgtgggtgccgacgacggccccgtaggaacaaagggtcttggagtgggatgggatggataccaaaccccctaaagaatgggtaggacaaacaaaactntagacaacgaagtaagtttcgaaggggacaaggggtaccaaccgatacgaacccgaaggggtaccacgtccaancagcaacagcctacagtggagcgagacgacagactcgaccatccgagaaaccgacacggacctaattttaactacgtgtagcggtaaggtacgttcggttaccggtggtcgtttcgttttaccgg

SEQ ID NO: 349403 - DNA, 577 bp, Homo sapiens
  misc_feature: GZ8MTXP02GJ1QI.45.37.D04.1.454.CMB.2.raw
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
  modified_base (344)..(344): a, c, t, g, unknown or other
  misc_feature (344)..(344): n is a, c, g, or t
  modified_base (366)..(366): a, c, t, g, unknown or other
  misc_feature (366)..(366): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtgggcctnagtgagtcnctgcagcttcnggctacncttcaccggcgactatcctccacgtgggtgcgaccgacggccccctgggacaaggggtcttggagtggagtgggatggataccaacccctaanagtggtacggacaacgaaactntgacacgaagtagtttcgagggtcgagggtcaccagtacgacgagggacaccgtacactcgagaccacgacgacctacagtcggagcgtagagacagactagacacgttacgacggaccgtacgaccggtaccttatttacgttacgtggttacgaacggtaggttaacggttcggtttaacgggcggttacgtttacgggtttttaccgg

SEQ ID NO: 349404 - DNA, 543 bp, Homo sapiens
  misc_feature: GZ8MTXP02GS2KT.45.37.D04.1.454.CMB.2.raw
  modified_base (230)..(230): a, c, t, g, unknown or other
  misc_feature (230)..(230): n is a, c, g, or t
  modified_base (441)..(441): a, c, t, g, unknown or other
  misc_feature (441)..(441): n is a, c, g, or t
tcagacgcgatcgacacgaccggtgctcgatttagtagcatactgttgggtttgggggagagcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggaagccgtggggcctnagtgaaggtctcctgcaaggcttctggctacaccttcaccggcgactatctccactgggtgcgacacggcccctggacaagggcttgagtggatgggatggatccaaacctaacaatggtggacaacaacgtatgacacgagtaagtttcgagggcagggtcacagtcgaaccgagggaccacgtcatacagacacacgctacagtgggancgtgacgcagactgacatcgagaacgacaccggacctattttaactagtaggtaagtaggtacggtagtttacggtttaaccggtgggttacgttttccggg

SEQ ID NO: 349405 - DNA, 588 bp, Homo sapiens
  misc_feature: GZ8MTXP02H2FBY.45.37.D04.1.454.CMB.2.raw
  modified_base (248)..(248): a, c, t, g, unknown or other
  misc_feature (248)..(248): n is a, c, g, or t
  modified_base (459)..(459): a, c, t, g, unknown or other
  misc_feature (459)..(459): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagcccggggctcagtgagtctcctgcaggcttcnggctacaccttcaccggcgactatcctccacgtgggtcgccgacgacggccccctaggaccaaggggcttaggaggtgggagtgggataggactaccgaaccctaacaagtgggacggacaacgaaacttatcgacaacgagtaacgtttcgaggggcagggtaccacagtacgaccgagggacacgtcactcagccacgacgaccctaancgtaggacgcctggacgacaggactagactacgtcgtagaccgaccgacgtaccttaatttaacgtcgtagttcgacggtaagtacggttcggttttacccgggtgtccgtttcggtttacgttttcgg

SEQ ID NO: 349406 - DNA, 676 bp, Homo sapiens
  misc_feature: GZ8MTXP02JUJO2.45.37.D04.1.454.CMB.2.raw
  modified_base (260)..(260): a, c, t, g, unknown or other
  misc_feature (260)..(260): n is a, c, g, or t
  modified_base (402)..(402): a, c, t, g, unknown or other
  misc_feature (402)..(402): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtggaggaaggccgtggggcctgaggtgaacggtctccgtgagaggcttcgnggctaccaccttccgaccggcgtactactcctccacgtggggtgccgacgaccggccccgtggaaccgaagggtcttggaggtggagtggggagtacggactaccgaaacccctaacgaagtgggtacgacaaacgaaactntacgacaacgtaagtaacgttcggaggggcacgggtacaacccagtacggaaccggaggaaccgaccgtaccacgtccgaacgaccaaccgaggtacccctaacgaagttacgggacgtacgtacggaacgacccggaagacccgttagacgtacgtaccttaacggaacccgaaccggtaaccggtacctaaatttttaccgtaagttccgtaggtaaccggtagttacggtttaccggttaaccgggttcggttcgtttcgggtttttaccg

SEQ ID NO: 349407 - DNA, 711 bp, Homo sapiens
  misc_feature: GZ8MTXP02GWKSO.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaaggtctctgcaaggcttctggctacaccttcgaccggcgactatcctccacgtgggtgcgacaccggccccgtggaacaaggggtcttggaggtggagtgggagtggaactacgaaaccccctaacaagtcgggtacggacaaactaaactagtacgacaacgtaagtaacgtttcgaacggggacgtaacggggtccaaacccgtaagtaccgaaacccggaacgggggaacctacccggtacctaacgccgaaacggacccaaacgaaccgtacccttaaccgtagtacggacggtacgtacggaacgacgaacgtacgagtaaacctacgttaccgtaacggaaacccgaccgtaacccgggtaccgttaaacttttaccgttacgttaccggtaggtaaccgggtaggttaaacggttttccggggtttaaacccgggttcggtttccggttttacggggtttttttaccccgg

SEQ ID NO: 349408 - DNA, 750 bp, Homo sapiens
  misc_feature: GZ8MTXP02HM88W.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgaccagtctccagacctcctggctgtgtctcgtgggcgaggacggccacatcaactgacaagtccagccagtagttgtttagacagcctacaaacaaataagaactactagcttacggtaccagacaagaaaccaggtcacgcctaccaagctagctactatttacgtcggactacgtacccgtaacccgggacgtcccggggtccccctacggaccgtattacgaggtcggacgcggggtccggggttacgtacgggtactacggttactttacctaaccttcctaaccaaccgtactaccgaggacccgtacgcccgttggaaccgacgggtactaagggaaaagttcgttagggttacggttacgtttaaggttttacgtcggcttacgttaaccggaagttacttaaaatttaacttttaatttaaaccttaccctttacccccgggtttaaccgtttaacccggttttaccccggggaaccccgggtttaaacgggaaaaccccgtttaaaagggttacggtaaaacttaaaccgttaaaaccccgaaaacgggtttaaacgtcgggtttacggtacctaacccgg

SEQ ID NO: 349409 - DNA, 552 bp, Homo sapiens
  misc_feature: GZ8MTXP02JB2DV.45.37.D04.1.454.CMB.2.raw
  modified_base (361)..(361): a, c, t, g, unknown or other
  misc_feature (361)..(361): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctgaggtgaggaagcctgggggcctcgagtgaggtctctgcaaggcttctggctacaccttcaccggcgactatcctccactgggtgcgacaggcccctggacaagggcttgagtggatgggatgggatcgaaccccctaacaatggtggcacaaactntgcacagaagtttacagggtcagggtcaccatacggaccgagggacacgtaccaancacncacacgacctacgagtaggagacgtagagacgacgactagactagtacgtacgacgaccgacgtacttaactttacttacgtgtgaacggtaggtacgttacggttaccggtcggttcgtttcggtttacg

SEQ ID NO: 349410 - DNA, 559 bp, Homo sapiens
  misc_feature: GZ8MTXP02JTB86.45.37.D04.1.454.CMB.2.raw
  modified_base (343)..(343): a, c, t, g, unknown or other
  misc_feature (343)..(343): n is a, c, g, or t
  modified_base (363)..(363): a, c, t, g, unknown or other
  misc_feature (363)..(363): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaggtctcctgcaaggcttctggctacaccttcaccggcgactatctccacgtgggtgcgacacggcccctggacaagggcttggagtggagtgggatggatacaaaccccctanaatggtacggcaacaaactntgacacgagaagtttcgagggcgaacgggtcaaccgatcggaaccgaggggacaccggtaccatacgacgcacgtacgacctacgagtcgggacgaccgtgacgcgaagactagacatcgtacgacgaccacggacctatttactacgtgtagcgtaaggtacttacggttaccggtgtccgtttcggttttcccg

SEQ ID NO: 349411 - DNA, 676 bp, Homo sapiens
  misc_feature: GZ8MTXP02GUAZO.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcgagtgaaggtctcctgcaaggcttcgtggctacaccttcaccggcgactatcctccacgtgggtgcgacgacggcccccgtggacgaagggtcttaggaggtggagtgggatggactaccaacccctaacgaagtggtacggacaacaaaactgtacgacaacgtaagtaagtttcgaaggggtccgaggggtaccaccgtagtacggaaccgaaggggaccaccggtaccaagtaccgacgacgaacctacgaccctaacgtagtacgggacgttaccgaggaacgacgaagtaacctaggaaacctacgtaccgtacggaaaccgtaccgtaacccgggtacccttaaagtttttacgtaaaccgttggtaacggtaacgggtaaacggtacgtttacgggtttaacccggggtcggtttacccggttttcggttttttaccccgg

SEQ ID NO: 349412 - DNA, 658 bp, Homo sapiens
  misc_feature: GZ8MTXP02JLH5R.45.37.D04.1.454.CMB.2.raw
  modified_base (224)..(224): a, c, t, g, unknown or other
  misc_feature (224)..(224): n is a, c, g, or t
  modified_base (254)..(254): a, c, t, g, unknown or other
  misc_feature (254)..(254): n is a, c, g, or t
  modified_base (272)..(272): a, c, t, g, unknown or other
  misc_feature (272)..(272): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtgggctnagtgaggtctctgcaggcttcgtggctacnccttcgaccggcactacncctaccacgtgggtcgacgacacggcccctggaacaagggcttggacggtggagtgggataggactaccaaacctaaccgagttcgggtacgacgaacaaaacttagtcgacaacgtaaagtacgtttcgaacggggacgacggggttaaccacgtaacgtacgaaccggaaggtaacccgaccggtaccaacgtaccgacgaccgactaaccgacccttaacgagtacgggacgtcgacggacgacaaacggtactcggaactacgtacgacggaaaccggtaccaaccgggtacttaatttaacgttacgtaggtaccgtaggtaaggttaccgtttacgggtttacgggcgtttacggtttcggttttaccgttttaccgggg

SEQ ID NO: 349413 - DNA, 587 bp, Homo sapiens
  misc_feature: GZ8MTXP02HTH0F.45.37.D04.1.454.CMB.2.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (258)..(258): a, c, t, g, unknown or other
  misc_feature (258)..(258): n is a, c, g, or t
  modified_base (449)..(449): a, c, t, g, unknown or other
  misc_feature (449)..(449): n is a, c, g, or t
  modified_base (477)..(477): a, c, t, g, unknown or other
  misc_feature (477)..(477): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagtagccacaagagcccactcccaggtgcagctggtgcagtcgtggggctggaggtgaggaagccgtggggcctnagtgaaggtctcctgcaggcttcnggctacnccttcacccggcgactatcctccacgtcgggtgccgacgacggccccctggaacgaagggcttgaggtggagtggggatggaactcaaaccctaacgaaagtgggtagacaacgaaactatgacaacgtaagtaacgtttcgacggggcgaggggttaccaactagacgaaccgacggaccaccgtaccanacgacgacacacgaccctagataggganacgtagagacagaccagaccatacgagacgaacgacggtccttaaattttactagtcgtagcgaggtaagttacggttacggtcgtcgtttcgtttaccgttttgaccgg

SEQ ID NO: 349414 - DNA, 563 bp, Homo sapiens
  misc_feature: GZ8MTXP02JVDLM.45.37.D04.1.454.CMB.2.raw
  modified_base (358)..(358): a, c, t, g, unknown or other
  misc_feature (358)..(358): n is a, c, g, or t
  modified_base (388)..(388): a, c, t, g, unknown or other
  misc_feature (388)..(388): n is a, c, g, or t
  modified_base (406)..(406): a, c, t, g, unknown or other
  misc_feature (406)..(406): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaggtctcctgcaaggcttctggctacaccttcaccggcgactatctccacgtgggtgcgacgacggcccctggacaagggcttgagtggatggatggatcaacccctacaagtggtaggcacaaactntgacacagaagttcagggcagggtcaccgntgaccgaggacacgtcancagcaacgcgacctacagtgggacgacgtggacgacaggaccgtagacctagttccgtaggaaccgaacgaccgggacccttaagttttaacgtaccgttagtggaaccgagggtacttacggtttaccggttcggtaccgtttgggtttttacccg

SEQ ID NO: 349415 - DNA, 599 bp, Homo sapiens
  misc_feature: GZ8MTXP02GFMKV.45.37.D04.1.454.CMB.2.raw
  modified_base (368)..(368): a, c, t, g, unknown or other
  misc_feature (368)..(368): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaggtctcctgcaaggcttctggctacaccttcaccggcgactatcctccactggggtgccgacacggcccctggacaagggcttggagtggagtgggatggataccaaacccctaacagtggtagacaacaaactnttacaactagtaagtttcgaggggtacgaagggtaccaccgtagtcgaaccgaaggggaaccaaccggtcccaataccgagaccgaacaacgaccctaacgagtagggaagcctaggacgcgaaggacctagaccagtcacgaacgacgacggtacctaaatttacgttacgtgtacggacgtaaggtagttacggtttaccggtgttcgttacggttttccttttacggg

SEQ ID NO: 349416 - DNA, 557 bp, Homo sapiens
  misc_feature: GZ8MTXP02IIA4F.45.37.D04.1.454.CMB.2.raw
  modified_base (369)..(369): a, c, t, g, unknown or other
  misc_feature (369)..(369): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggtcttctggctacaccttcgaccggcgactatcctccacgtgggtgcgacgacggcccctggacgagggtcttggagtggagtgggatggatcaaccccctaagagtggtagacaacaaactntacgcaacgagtaacgttcgagggcagggtcaccgatacggaccgagggacacgtccatcagcacacgacctacagtggagcgtgacgcagactgactatcgtacgacgacgacggtacctaatttacgtacgtggtacgaaggtacggtcgttacggtttaccggtggttacgtttcggtttttccg

SEQ ID NO: 349417 - DNA, 616 bp, Homo sapiens
  misc_feature: GZ8MTXP02GQDDQ.45.37.D04.1.454.CMB.2.raw
  modified_base (239)..(239): a, c, t, g, unknown or other
  misc_feature (239)..(239): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctgagtgaaggtctcngcagcttcnggctacnccttcaccggcgactatctccacgtgggtgccgacgccggcccgtggaacgaaggtcttacggagtggaggtggtagtaggactaccaaaccccgtaactagtggtacggacaaactaaactagtcgacaacgtaagtaacgttacggagggacgtacgggtaccaaacgagtacggaaccggaacgggtaacctaccggtaccaacgtacgacgaccacgaacgaccctagagtagggaacgcgtagacgacgagactagactacgttacacggaccacgacggtaccttaagtttactacgtggtacgaacggtagttacggttcggttacggtcggttcggtttacggtttttaccgg

SEQ ID NO: 349418 - DNA, 613 bp, Homo sapiens
  misc_feature: GZ8MTXP02JGPTX.45.37.D04.1.454.CMB.2.raw
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctctgcaggtcttcgnggctacnccttcgaccggcgactactcctccacgtgggtcgcgacgacggcccctggacgagggtcttggagtggagtgggatggactaccaaccccgtaagagtggtagacaacaactgtgacacgtagtagttcgagggcagggtccacgagtacgaccgtaggggaccaccgtaccactcgacgcaacgacgtacctacgagtacgggacgtcgtacgacgaccgaggtaactaggaactagtaccgtacgaaccgtacgaacccggtacttaacgttttaacgttaccgtgtacggaaccggtaaggttacggttccggtttacgggtcggttaccggtttcggtttttacccgg

SEQ ID NO: 349419 - DNA, 550 bp, Homo sapiens
  misc_feature: GZ8MTXP02FNHQA.45.37.D04.1.454.CMB.2.raw
  modified_base (229)..(229): a, c, t, g, unknown or other
  misc_feature (229)..(229): n is a, c, g, or t
  modified_base (471)..(471): a, c, t, g, unknown or other
  misc_feature (471)..(471): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctnagtgaaggtctcctgcaaggcttctggctacaccttcaccggcgactatctccactgggtgcgacaggcccctggacagggcttgaggtggagtggggatgggatacccaaaccctaacaagtgggtaggaccaacgaacctatagacacgagtaagtttcgaggggcaggggtacacccgataggacccaggggacacgtcatacagcacacgccacgacgtggagctagacgcaagacgngacactcgagaccgaacgaccggtacctaagtttactacgtgtcgcgaggttacttcggtttacgtcggtcttttcggg

SEQ ID NO: 349420 - DNA, 502 bp, Homo sapiens
  misc_feature: GZ8MTXP02I8POZ.45.37.D04.1.454.CMB.2.raw
  modified_base (289)..(289): a, c, t, g, unknown or other
  misc_feature (289)..(289): n is a, c, g, or t
  modified_base (341)..(341): a, c, t, g, unknown or other
  misc_feature (341)..(341): n is a, c, g, or t
  modified_base (427)..(427): a, c, t, g, unknown or other
  misc_feature (427)..(427): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtncgacaggcccctggacaagggcttgagtggatgggatggatccaaccctaanaagtggtaggcacaactatgcacagaagtttcgagggcagggtcaccatgaccaggaccacgtccatcagcacagcctacatgganctgagcagactagacatctgacgacacggctactttatactgtgcgagtacgtacgtttacggtggtctttcggg

SEQ ID NO: 349421 - DNA, 604 bp, Homo sapiens
  misc_feature: GZ8MTXP02JTG56.45.37.D04.1.454.CMB.2.raw
  modified_base (363)..(363): a, c, t, g, unknown or other
  misc_feature (363)..(363): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacgacggcccctggacaagggcttgagtggatgggatggatcaaaccccctaacaagtggtagcaacgaaatntgcaacgagaagtttcgagggcagggtcacatcgacagggacacgtacatcacgcaacgacgtacctaacgcgtagggacgtcgacggacgccgaaagtcgagacgtacgttaccgtacggaaaccggaccgtaaccgggtaccttaagtttacgttaccgttacggtaggtaaccggtacggttaaagttttcggggtttaaccgggtcggtttaccgttttcgggttttttaaccccgg

SEQ ID NO: 349422 - DNA, 564 bp, Homo sapiens
  misc_feature: GZ8MTXP02GEQZS.45.37.D04.1.454.CMB.2.raw
  modified_base (258)..(258): a, c, t, g, unknown or other
  misc_feature (258)..(258): n is a, c, g, or t
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
  modified_base (340)..(340): a, c, t, g, unknown or other
  misc_feature (340)..(340): n is a, c, g, or t
  modified_base (360)..(360): a, c, t, g, unknown or other
  misc_feature (360)..(360): n is a, c, g, or t
  modified_base (417)..(417): a, c, t, g, unknown or other
  misc_feature (417)..(417): n is a, c, g, or t
  modified_base (475)..(475): a, c, t, g, unknown or other
  misc_feature (475)..(475): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctctgcaggctctggctacncctcacggcactatctccactggncgacncggcccctggacgaggcttggagtggagtggatggactaccaaaccccctaanaagtggtagacaacaaactnacgacaacgagtaagttcgagggctagggtcaactagacgaccgaaggacacgtcanacgacgactaacgacgacctaacgagtaggacgactaggacgacacggactgaactancgtacgaccgacgtacggaccttaatttacgttacgtggtaacgcggaagttacgttacggttaccggtgttcggtttcgttttaccgg

SEQ ID NO: 349423 - DNA, 614 bp, Homo sapiens
  misc_feature: GZ8MTXP02HCQIS.45.37.D04.1.454.CMB.2.raw
  modified_base (256)..(256): a, c, t, g, unknown or other
  misc_feature (256)..(256): n is a, c, g, or t
  modified_base (349)..(349): a, c, t, g, unknown or other
  misc_feature (349)..(349): n is a, c, g, or t
  modified_base (450)..(450): a, c, t, g, unknown or other
  misc_feature (450)..(450): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaggtctcctgcaggcttctggctacnccttcaccggcgactatctccacgtgggtgcgacgacggcccctaggacgaagggcttggagtggagtgggatggataccgaaaccccctaanaagtggtaggacaacgaaaactgtgacaacgagtaagtttacgaggggaccaggggtaccaaccgatacggaaccgaaggggaccaccggtccataccgancaacgacgacctaacagtacgggagtacctaggacgacgtaacgaacgtaggaacctagtcgtaacggaccggaacctaccgggtaccttaagtttacttaaccgtgttaggaacggtaggtaacgttcggggtttaccggtggttccgtttcggtttttcccg

SEQ ID NO: 349424 - DNA, 638 bp, Homo sapiens
  misc_feature: GZ8MTXP02HTFRW.45.37.D04.1.454.CMB.2.raw
  modified_base (259)..(259): a, c, t, g, unknown or other
  misc_feature (259)..(259): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtcgtggggctggaggtgagggaagccgtggggcctcgagtgaaggtctctgcagctctggctacnccttcaccggcgactactcctaccacgtgggtgcgacgacggcccgtggacgaagggtcttaggaggtggagtgggataggtactaccaaacccccgtaagaagtgggtacgacaaccgaaactagtcgacaacgtaggtaaacgtttcgaacggggtcgacggggtacctaccgaagtacggaaccgaacgggaaccgaccgtaccacgtacgaacgaccgtaaaccgacgtaccctaacgtacgtaacgggacgtccgtagacgacgaacgtactacggactaagtctacggaccgacgtaaccggtactactttacgttactggtgtaaccgtaggtacgtttcgggtacggttcggtacgtttcggtttttaccg

SEQ ID NO: 349425 - DNA, 519 bp, Homo sapiens
  misc_feature: GZ8MTXP02GNL71.45.37.D04.1.454.CMB.2.raw
  modified_base (286)..(286): a, c, t, g, unknown or other
  misc_feature (286)..(286): n is a, c, g, or t
  modified_base (342)..(342): a, c, t, g, unknown or other
  misc_feature (342)..(342): n is a, c, g, or t
  modified_base (359)..(359): a, c, t, g, unknown or other
  misc_feature (359)..(359): n is a, c, g, or t
  modified_base (388)..(388): a, c, t, g, unknown or other
  misc_feature (388)..(388): n is a, c, g, or t
  modified_base (501)..(501): a, c, t, g, unknown or other
  misc_feature (501)..(501): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtncgacacggcccctggacaagggcttgagtggagtgggatggatacaaccccctaanatggtcgacacaaactntgacacagagttcgagggtcaggtcacangaccgaggacacgtcagtcagacacgacgacctacgagtggaagtcagagcagactgacatcagacacacggcctaatttactactgtacgaagtagtacgttcgttaccggnggtcgttcggttttaccg

SEQ ID NO: 349426 - DNA, 591 bp, Homo sapiens
  misc_feature: GZ8MTXP02JRHON.45.37.D04.1.454.CMB.2.raw
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (365)..(365): a, c, t, g, unknown or other
  misc_feature (365)..(365): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggagccgtggggcctnagtgaggtctcctgcaggtcttnggctacnccttcaccggcgactatctccagtgggtgcgacgacggcccctggaacgaagggtcttggagtggatgggatggatcaacctctaaacaagtggtcggacaacaactntgacacgagtaacgtttcgagggcgaggtcacgagtcgaacgaggacacgtcatcgagcacgacgccctaagacgtgggacgtcgtacggaacgacgaacggacctacggactacgttaccgaggaaccgaaccgtaccggtacctttaactttacgttaacgtcggtaaggtaccggtaaggtacgtttacgggtttaaccgggtcggttccggtttttaccggg

SEQ ID NO: 349427 - DNA, 516 bp, Homo sapiens
  misc_feature: GZ8MTXP02F44T8.45.37.D04.1.454.CMB.2.raw
  modified_base (249)..(249): a, c, t, g, unknown or other
  misc_feature (249)..(249): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (414)..(414): a, c, t, g, unknown or other
  misc_feature (414)..(414): n is a, c, g, or t
  modified_base (417)..(418): a, c, t, g, unknown or other
  misc_feature (417)..(418): n is a, c, g, or t
  modified_base (428)..(428): a, c, t, g, unknown or other
  misc_feature (428)..(428): n is a, c, g, or t
  modified_base (468)..(468): a, c, t, g, unknown or other
  misc_feature (468)..(468): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagtagccacaagagcccactcccaggtgcagctggtgcagtctggggctgaggtgaggaagcctggggcctcagtgaaggtctcctgcaaggcttcnggctacaccttcaccggcgactatctccactggtgcgacagcccctggacaaggctgagtggatgggattggatacaaacctaacaatggtgacacaaatatgcacagaagtttcagggtcagggtcaccatacgacgagggacagtcancagnacagctacagngannagagcagacngacatacgacgacgacgacgactatttactacgtgtacgngtagtaagttacggttacggtcggtcgtttcggtttacgtttacgacg

SEQ ID NO: 349428 - DNA, 615 bp, Homo sapiens
  misc_feature: GZ8MTXP02JGV10.45.37.D04.1.454.CMB.2.raw
  modified_base (370)..(370): a, c, t, g, unknown or other
  misc_feature (370)..(370): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcgagtgaggtctcctgcaggcttctggctacaccttcaccggcgactatcctccacgtgggtgcgacgacggccccctggacaagggcttggaggtggagtgggatggataccaacccctaacaacgtggtggcaacgaactntgcacgagtaagtttcgaggggcacgggtcaacccgagtacgacccgaaggggaccacgtaccgactcacgcaaccgacggcctaacagtacggagtccgtagaagccgaaggacttaggacctagtctacggaacccgacgtaccggtaccttaagttttaccgttaaccgtcggttagaaccgggtacggtaagtttaccgggtttaacccggtgggtaccgttttcggggtttttaaccccg

SEQ ID NO: 349429 - DNA, 689 bp, Homo sapiens
  misc_feature: GZ8MTXP02HVCXR.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtggaggaacgccgtggggcctcgaggtagaaggtcctcgtgacgaaggtcttcgtggtacctaccacccttcgaccgggctaactacgtcctaccgtacgtgggtcgacgaccgaccggcccccgtagggaaccgtaagggtcttaggagggtggtaggtagggattacggactaaccctaaacccctaacgtaagtcgggaacggactaaaccgtaaatcgtacggaacctaaagtaaggttaacgtttacggaacggggtaccgacgggtaaccaaccgtaagaccggaccggaaagggtaacccgaccgtacaagaccgaacgacgaacgaccgtactaacgtaggtaggacgacgtagacgacgaacggactacgaatacgtacgacggaaccacggacgtaccttaaagtttactacgtcgtagaacgttaggtacgtttacggttcggtacgttcgttttacggttttaccgg

SEQ ID NO: 349430 - DNA, 577 bp, Homo sapiens
  misc_feature: GZ8MTXP02I0F0Y.45.37.D04.1.454.CMB.2.raw
  modified_base (317)..(317): a, c, t, g, unknown or other
  misc_feature (317)..(317): n is a, c, g, or t
  modified_base (374)..(374): a, c, t, g, unknown or other
  misc_feature (374)..(374): n is a, c, g, or t
  modified_base (414)..(414): a, c, t, g, unknown or other
  misc_feature (414)..(414): n is a, c, g, or t
  modified_base (452)..(452): a, c, t, g, unknown or other
  misc_feature (452)..(452): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaacgtccagccagtagtgttttagacagctcaacaataagaactactagcttggaccagcagaaaccaggtacacgacctcctaagctgctctatttacngggctacgtaccgtaccccgggaagtcccgggtccccctagaccattcgagtcggcngggccgggtcgtgggacagtactttcgactcgtacacctntacgacgctacgcccgtgacgacggcttacggaaagtntggggtacgtacgttagtttacgtcgacctggtacagtactattattattatacttcgttacgactttcggaccctagggaacctaggtgtaactacgtaacgaaaactgtcggtacgactccgg

SEQ ID NO: 349431 - DNA, 639 bp, Homo sapiens
  misc_feature: GZ8MTXP02G5CKO.45.37.D04.1.454.CMB.2.raw
  modified_base (332)..(332): a, c, t, g, unknown or other
  misc_feature (332)..(332): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggtgaggagggcccaccatcaactgacaagtccagccagtagttgtttagacagcctaccaaacaataagaaactacttagcttaggtaccagacaacgaaaccgaggtcacgcctacaagctgctactaatttacgnggacacgtacccgtaaccgggaacggttccccgggtccccctacgaccgtagttacgaaggtcggcgacggggtccgggtcgtacggggactagtactttccgaccttccactaaccctatcgacggctacgccctagaccgagggactaggaaagtgtggtacggtactttagtttacgtggtcttaggacaagtaacttaaatttatttaattacgtttacttcccccgttagtaccccgttttaccggacccgttagggaaaccttaaggtgaaactactaacgaaacgtactggacgtacacg

SEQ ID NO: 349432 - DNA, 587 bp, Homo sapiens
  misc_feature: GZ8MTXP02JUUVD.45.37.D04.1.454.CMB.2.raw
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctaccaacaataagaactacttagcttaggtaccagacagaaaccaggtcagcctctaagctgctcatttaccgtgggactacgtaccgtacccggggtaacgtcccggggtacccccctggacccgtatttccaggttcggctacgggtccggggtacgtgggggactaggtactttcacctctaccaccctatcgagccacgccctgccagggctaggaaagtntggnggtctagtttacgtgctggtacagtactaattattattacttacttcccgttcgtacgttccgaccgttacgggacctaaaggtcgaatactaacgaaacgtacgtgtcgactcg

SEQ ID NO: 349433 - DNA, 585 bp, Homo sapiens
  misc_feature: GZ8MTXP02GKS0P.45.37.D04.1.454.CMB.2.raw
  modified_base (352)..(352): a, c, t, g, unknown or other
  misc_feature (352)..(352): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaaggtctcctgcaaggcttcgtggctacaccttcaccggcgactatctccacgtgggtgcgacacggcccctaggacaagggctgagtggatggggatggactacccaaaccctaanaagtggtggacaacaactnagtacanagtaagtttcgagggtcgagggtaccacagtacgacgacgggaccacggtccatacgagaccacgaacgcccttaagagttacgggagccgtaggaacgcgtaacgacgtaggaactactaccgtacgaccgaaccgacggtaccttaagtttactacgtagtcgacggtaaggtacgttcggtttaccggtcgttacgttttcggg

SEQ ID NO: 349434 - DNA, 684 bp, Homo sapiens
  misc_feature: GZ8MTXP02GYKWL.45.37.D04.1.454.CMB.2.raw
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaagccgtggggcctcgagtgaaggtctccgtgacaggtcttcgtggctacaccttcgaccggcgactactctccacgtggtcgcgacgacggcccctaggacgaaggcttggagtggagtgggatggactaccgaaacctaacaagtggtacggacaaactaaaactgtcgacaacgtaaggtaaacgtttcgagggacgtacgggtacctaacgagtacggaacggaacgggtaacctaccggtaccaacgtaccgaacggacctaaccgaaccggtacccttaaacgacggttagggacgtccgtaaggaccgacgacgggtaactacggaactacgtaccgtacggaaacccgaacggtaccggtaaccttaagttttaacgttaccgtaggtacggaccggtaaggttacgttacggggtttacccgggtggtttacgttttccggggttttacgttttaaccgggg

SEQ ID NO: 349435 - DNA, 532 bp, Homo sapiens
  misc_feature: GZ8MTXP02GVHYO.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcgaccggcgactatctccactgggtgcgacacggcccctggaccaaggggcttggagtggatgggatggatacaaccccctaacaatgggtggacaacaaaactatgacacagtaagtttcagggcaggggtcaacgatagaccagggacacgtcatcagcaacagacctacagtggagctgacgcagactgacatcagaccgacgacggacctatttaactactgtacgcgaggtacttcggttaccggtggtcgtttcggttttaccg

SEQ ID NO: 349436 - DNA, 542 bp, Homo sapiens
  misc_feature: GZ8MTXP02F5DJX.45.37.D04.1.454.CMB.2.raw
  modified_base (359)..(359): a, c, t, g, unknown or other
  misc_feature (359)..(359): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactgtacctggaggatcctcttcttggtggcagcagccacaagagcccactcccaggtgcagctggcgcagtctggggctgaggtgaggaagcctggggctcagtgaaggtctcctgcaaggcttctggctacaccttcaccggcgactatctccactgggtgcgacacggcccctggacaagggcttgagtggagtgggatggatcaaccccctaacagtggtggacacaaactntgacacgagaagtttcgaggggcaggggtcacccgatacgaccagggacacgtccatcagcacagcctacatggagctagagcacgacgtgactagtcctagaccgtacgacggtacctatttactacgtgtacgcgtaggtaacgttcggtttaccgggtggtccgttacggtttttcccgg

SEQ ID NO: 349437 - DNA, 665 bp, Homo sapiens
  misc_feature: GZ8MTXP02GKW7R.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaggtctcctgcaaggcttcgtggctacaccttcgaccggcgactatcctccacgtgggtcgcgacgacggccccgtaggaacgaagggtcttggaggtggagtgggatggactaccgaaaccccctaacgagtgggtcggacaacgtaaaactgtcgacaacgtagttaacgttcggaggggacgtaacggggtaccaaccgtagtacggaaccggaacgggaaccgtaccggtaccaacgtccgaacgaccgaaaccgacgtacccgtaacgtagtacgggacgtccgtaggacgacgaacggtactacggaactagttaccgtaacggaaccgaaccgaccggttaaccttaacgttttacgtacgttgtacggaacggtaaggtacgtttaccgggttacggtcggttccgtttacggtttttacccgg

SEQ ID NO: 349438 - DNA, 619 bp, Homo sapiens
  misc_feature: GZ8MTXP02IDO1K.45.37.D04.1.454.CMB.2.raw
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
  modified_base (338)..(338): a, c, t, g, unknown or other
  misc_feature (338)..(338): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtgggcctnagtgaggtctctgcaggcttngctacnctcgcgcactntctccagtggtgcgacgacggcccctggacgagggcttaggagtgggagtgggagtcggataccgaaccctaanaacgtgggtacgacaaacgtaaactgtgacaaacagttaaagtttcgacgggtacaacggggtccaacgagtacgaccggaagggacccacgtccactacgacgcaaccgacgacctaacgagttaggacgtcgagacgacgacgactcgactacgtccgacgaaccgacgaaccggtctttaaactttacgtacgttcgggtacctagggaacggttacggtttccgggtttaccgggttcgggtttccgttttccgggtttttaccggttttaccgggg

SEQ ID NO: 349439 - DNA, 622 bp, Homo sapiens
  misc_feature: GZ8MTXP02IOAGQ.45.37.D04.1.454.CMB.2.raw
  modified_base (257)..(257): a, c, t, g, unknown or other
  misc_feature (257)..(257): n is a, c, g, or t
  modified_base (374)..(374): a, c, t, g, unknown or other
  misc_feature (374)..(374): n is a, c, g, or t
  modified_base (437)..(437): a, c, t, g, unknown or other
  misc_feature (437)..(437): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagcgtgggcctgagtgaggtctccgtgcaggctcgtggctaccnccttcaccggcgactactctccacgtggtgcgacgcggcccctggaacgaaggcttggaggtggagtgggatggaactaccaaacccccgtaagaagtggtacggacaacaaaactntcgacaacgtaagtaacgtttcgagggacgaggtaccacgagtcgaccgaggacaccgtacanacgagaccaacacgacctacgagtaggaacgtcgagaacgcaaacgtcgacgactagtccgtaacggacccgaaccgtacggtaacctttaagtttactaaccggtttgacggtaaccggtaaaggttacggtttaccggtttaaccggggttcggtttaaccggttttcgggtttttaacccgg

SEQ ID NO: 349440 - DNA, 646 bp, Homo sapiens
  misc_feature: GZ8MTXP02IB88Y.45.37.D04.1.454.CMB.2.raw
  modified_base (377)..(377): a, c, t, g, unknown or other
  misc_feature (377)..(377): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtggggcctcagtgaggtctctgcaggcttctggctacaccttcaccggcgtactatcctccacgtgggtgcgacgacggcccagtggacgaagggtcttggaggtggagtggggatggactaccccaaacccgtaagaagtgggtacgacaactaactntcgacaacagtaacgtttcgagggtacgaggggtaccaaccgagtacggaacccgaggggaccacggtaccagtacacgacaaccacggaccctagagtcgggaacgccgtaggacgaccgaaacggacgttacgaacgtacttaccggtacggaaccgaaccgtaaacccgggtactttaacgttttaacttaccgttaggtaacggtaaccgggttaaggtacggtttacggggtttaccgggttcgggttaccggtttttccgggg

SEQ ID NO: 349441 - DNA, 671 bp, Homo sapiens
  misc_feature: GZ8MTXP02HQ9VC.45.37.D04.1.454.CMB.2.raw
  modified_base (258)..(258): a, c, t, g, unknown or other
  misc_feature (258)..(258): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtctggggctggaggtggaggaagccgtggggcctcgaggtgaaggtctcctgcgaaggcttcnggctacaccttcgaccggcgactatcctccgacgttggggtcgaccgacgaccggccccgtggacgaagggtcttaggaggtggagtagggagtggactaccgaaaccccctaagaagttcgggacggacaaacgtaaatactcggacaacgtaggtaacgtttcggaacggggtcgaacggggtacaacccgagtacggaacccggaacgggaccaccggtaccacgtacgacgaccacgacgtacctacgtagtacggaacgcgtaggacggactaacggactacggactaacgtaccgtacggaaccgggtaccaaccggtacctttaaatttaacgttccgtacggtgaaccggtaaggtcggtttacggtttaaccgggtcggtttaccggtttcggtttttacccgg

SEQ ID NO: 349442 - DNA, 595 bp, Homo sapiens
  misc_feature: GZ8MTXP02F3FGI.45.37.D04.1.454.CMB.2.raw
  modified_base (346)..(346): a, c, t, g, unknown or other
  misc_feature (346)..(346): n is a, c, g, or t
  modified_base (361)..(361): a, c, t, g, unknown or other
  misc_feature (361)..(361): n is a, c, g, or t
  modified_base (396)..(396): a, c, t, g, unknown or other
  misc_feature (396)..(396): n is a, c, g, or t
  modified_base (421)..(421): a, c, t, g, unknown or other
  misc_feature (421)..(421): n is a, c, g, or t
  modified_base (430)..(430): a, c, t, g, unknown or other
  misc_feature (430)..(430): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagttgtttagacagctaccaaacaataaagaactactagcttggtaccagcagaaaccaggtcagcctcctaagctgctcatttactggcatccgtaccggaagtccggggtccccngaccgattcagtgcngggcggtctggggaccagtacttcactctcaaccntcagcagcctgcaggctagaaagtntggtacggnttaggttttatgtaccttgtacaacgtactaaatttatttaatttaacttactttacccgtaccggtttaccgttttacccgggccgtttaaccggggaaaccgtaaaggttacggtaattaaacgtaaccgtaaaaacgtaacgttcgggtaacgcgttacccg

SEQ ID NO: 349443 - DNA, 620 bp, Homo sapiens
  misc_feature: GZ8MTXP02JU2W3.45.37.D04.1.454.CMB.2.raw
  modified_base (367)..(367): a, c, t, g, unknown or other
  misc_feature (367)..(367): n is a, c, g, or t
  modified_base (392)..(392): a, c, t, g, unknown or other
  misc_feature (392)..(392): n is a, c, g, or t
tcagacgcgatcgacacgaccggtgctcgatttagtagcatactgttgggtttgggggcatcaccccagcaaccacatctgtcctctagagaatccccctgagagctccgttcctcaccatggactggacctggaggatcctcttcttggtggcagcagccacaagagccccactccccaggtgcagctggtgcagtcgtggggctggaggtgaggaagccgtggggcctcagtgaaggtctcctgcaaggcttcgtggctacaccttcgaccggcgactatcctccacgtggggtgccgacacgggtccccctaggaccgaaggtcttaggagtgggagtgggatcggactacctaaacccgtaanaagtggtacggacaactaaaacgtntcgacaacgaagtaacgttcgagggcgtagggtccaacgtagacgaccgaaggggaccaccggtaccaacgtccgaagaccacaacgcctaacgaggtggaacgcgtagacgacgagactagactacgtcgacggaaccgaccgaccggtccttaaagtttactacgtggtacgtagtaaggttacgtttacgggttaccggtgtcgttttacggtttacgtttacgg

SEQ ID NO: 349444 - DNA, 645 bp, Homo sapiens
  misc_feature: GZ8MTXP02HLHCJ.45.37.D04.1.454.CMB.2.raw
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctcagtgaaggtctcctgcaggctngctacnctcgacgcactatctccacgtgggtgcgacgacggccccgtaggacgaagggtcttaggagtggagtggggatggactaccaacccctaagaacgtgggtacggacaacaaaactgtacggacaacgtagtaacgtttcgaacggggtcgaacggggtccaacccgtaagtacggaaccggaacggggaccaaccggtccaactacgaacgccaacgaccgacctaacgagtacggaacgcgtaggacgacgaacgacgttacggacctaactccggaacgaacccggaccgaacgggtacccttaaagtttacgttaaccgtggttacggaacggtaggtaacggtttcggtttaaccgggtcggttaccgtttcgggtttttaaccgg

SEQ ID NO: 349445 - DNA, 699 bp, Homo sapiens
  misc_feature: GZ8MTXP02HUTYO.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctggaggtggaggaagccgtggggcctcgagtagaaggtcctctgacgagtctctggctactacctcgaccggacgactatcctaccgacgtggggtcgaccgacgaccggtccccgtagggaaccgtaaggggtcttaggtaggtgggaggttaggggattcgggaactaaccgtaaaccccctaaacgaagttcgggtacggactaaaacgtaaacgtgtggaaaccaacgtaacgggttaaacgtttacggaacgggggtacgtacggggtaccaaccgagtaccgaacggtaacgggaacctacccgttacacgcacggactaacgaccggtacctaacgtagtacgggacgacgtagacgacgaacggtactacgactacgttaccgtacgaaaccgacgtaccggtacttttaaacgttacgttacgtgtacgaacggttagttacggtttaccgggttacggtcggtttcgttttacggtttttacccgg

SEQ ID NO: 349446 - DNA, 607 bp, Homo sapiens
  misc_feature: GZ8MTXP02GVPUU.45.37.D04.1.454.CMB.2.raw
  modified_base (380)..(380): a, c, t, g, unknown or other
  misc_feature (380)..(380): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaggtctcctgcaggcttcgtggctacaccttcaccggcgactactctcccacgtgggtgcgacgacggccccgtaggacgaagggcttggaggtggagtgggagtggaactcaaaccccctaagaagtggtagacgaacaaacgtntgacacgagtaagttcgagggcgacggtacacagtacgaccgaggacaccgtcactacacgacaccgacgacctacgagtaggacgacgtagacgacgaacgtactacgaacgtactacgtacggaaccggaaccgaccggtaccttaagtttacgttaacgtggtacgtaacggtaggtacggtttacggtttacgggtcggtttccggtttcggtttttaaccgg

SEQ ID NO: 349447 - DNA, 547 bp, Homo sapiens
  misc_feature: GZ8MTXP02FF8II.45.37.D04.1.454.CMB.2.raw
  modified_base (437)..(437): a, c, t, g, unknown or other
  misc_feature (437)..(437): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcacccggcgactatcctccacgtgggtgcgacacggcccctggacagggcttgagtggagtggggatggatacccaaaccctaacaagtggtggacaacaactatcgacacgagtaagtttcgaggggcgtagggtacaccatcgaaccgagggacacgtaccatcagacacngcctacataggagcgtgacgcagactagacatccgtagacgacgacggtacctactttactactagtcgacggtacggtacgtcggtttaccggtcggtcgttttaccgg

SEQ ID NO: 349448 - DNA, 672 bp, Homo sapiens
  misc_feature: GZ8MTXP02HHII6.45.37.D04.1.454.CMB.2.raw
  modified_base (227)..(227): a, c, t, g, unknown or other
  misc_feature (227)..(227): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctnaggtgaaggtctcctgcaaggcttcgtggctacaccttcaccggcgactatctccacgtgggtgcgacgacggccccgtggacgaagggtcttggagtggagtgggatggactacaaacccccgtaaacaagtggtcggacaacgaaaactatcgacaacgtaagtaagtttacgagggggtcaacggggttccaaaccgagtacggaaccgaaggaccaccgtccacgtacacgacaacgacgtacctacagtgggaacgtcgaggagaccgaagaccgttagaaccgtacgtcgtaccgggaaaccgaccgaaaccgggtacccgtttaaatttttaaccgtttaccgttggttacgaaccggtaaggggtttaacgtttaaccggggtttttacccggggttacggggtttaccggtttttccggggtttttttaaccccgg

SEQ ID NO: 349449 - DNA, 649 bp, Homo sapiens
  misc_feature: GZ8MTXP02ISO91.45.37.D04.1.454.CMB.2.raw
  modified_base (222)..(222): a, c, t, g, unknown or other
  misc_feature (222)..(222): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagctgggctngtgaggtctcctgcaaggcttctggctacaccttcaccggcgactactctccacgtgggtgccgacgacggccccagtcggaacgaagggcttaggagtgggagtggggatggaactacccaaaccccgttaagaagtgggtaggaccaaacaaccgttacacgaaccgaacgtaaggttaacgttacggacgggtacgtacggaccaacgtacgtacgaaccgacggaccaccgtaccgaactaccgacgaccaaaccgtaccgtacctaacgaggtacgggacgacgtacggacgacgaacgtacgtacgacgtacgtacgacgaaccgaaccgtaccgtaactttaacgtttacgttacgtacggtaacggtacggtacggttacgtttacgggtttaccgggttacggtttaccggttttcgg

SEQ ID NO: 349450 - DNA, 568 bp, Homo sapiens
  misc_feature: GZ8MTXP02IHTZ4.45.37.D04.1.454.CMB.2.raw
  modified_base (345)..(345): a, c, t, g, unknown or other
  misc_feature (345)..(345): n is a, c, g, or t
  modified_base (468)..(468): a, c, t, g, unknown or other
  misc_feature (468)..(468): n is a, c, g, or t
  modified_base (474)..(474): a, c, t, g, unknown or other
  misc_feature (474)..(474): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttctggctacaccttcaccggcgactatcctccacgtgggtgcgacacggcccctggacaagggcttgagtggatgggatggatccaacccctaanaagtggtacggcaacgaaactgtcgcaacgagtaagtttcgagggacgagggtcaccgagtacgaccgagggacaccggtacatcgagcaacgagacctacgagtggatcgagagacagtacngaaccnttcagacgacgacgtacctaattttactaacgttgtacgaacggtaaggtacttacgggttttaaccggtcggtacgtttcggtttttacccgg

SEQ ID NO: 349451 - DNA, 786 bp, Homo sapiens
  misc_feature: GZ8MTXP02HA4WA.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgaccagtctccagacctcctggctgtgtctcgtgggcgaggacggccaaccatacaactgacaagtccagaccagagttgtttagacagcctacaaaactaaataaagtaactacttacgtcgttacggtaaccagacaaacgaaaccgaggtacacgcctacaagtctacgctactatttacgtcggactacgtaccgtacccggggaacgttcccgggtacccctacggaccgtattacgaggttcggacgtacgggtccggggtacgtacgggggaactacggttactaccgtaaccttccgacaaacccgtataccgacgtaccgacgtccgacggacgaagtacgtaaggtaaagtcgttacggtaggtttacgtttagtttacgtcgtacgttaacggtacgtaaacgttaaacttaaaagtttaactttaaaacgttttaacccgtttaccccgtttaaccccgggtttaccgtttacccccgggtttaccccggggtaaccgggtaaaaccggggttaaaaccgttaaaaggggtttaaccggtaaaacggttaaaaccgttaaaaaccgggtaaaaccggtttaccggttacgggttaacccggtaacccgtaaccgg

SEQ ID NO: 349452 - DNA, 689 bp, Homo sapiens
  misc_feature: GZ8MTXP02HW5JB.45.37.D04.1.454.CMB.2.raw
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttctggctacaccttcgaccggcgactactctaccacgtgggtgcgtacacggcccctaggacaagggctttggagtggagtggggactggactacccgaaaccctaaagtaaacgtgggtacggaccaactaacgttagtacggaccacgtaaggtaacgtttcggacggggtaccacgggggtacccaacccgtaagtaccgaacccggaagggggaaacccgtaccggttacccaacgttaccgaacggaccaaccgaacggtaccttaaacgacggttagggaacgccgtaggacgccgaaaggacctaggacctaacgttccgtacgaaacccgacgaccgggtacctttaacgtttagttaccgtaggttggaccgggtaagggttacgtttacggggtttaacccgggtcggtttcccgttttaaccgggg

SEQ ID NO: 349453 - DNA, 615 bp, Homo sapiens
  misc_feature: GZ8MTXP02F2M2Z.45.37.D04.1.454.CMB.2.raw
  modified_base (199)..(199): a, c, t, g, unknown or other
  misc_feature (199)..(199): n is a, c, g, or t
  modified_base (380)..(380): a, c, t, g, unknown or other
  misc_feature (380)..(380): n is a, c, g, or t
  modified_base (450)..(450): a, c, t, g, unknown or other
  misc_feature (450)..(450): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccgaggtgcagctggtgcagtcgngggctgaggtgaggagccgtgggctcgagtgaggtctcctgcgagcttcgtgctaccacctcgaccggcactactcctccacgtggtcgcgacgaccggccccgtaggacgtagggtcttaggaggtggaggtagggagtggaactaccgaaacccctaagagtggacgacaactaaactncgacaaacgtagtagttcgacgggcgtacggtcacgagtacgaaccgtagggaccaccgtacataccganaccaacgacgacctacgacgtgggactacgagacgacaacggactagaactacgtcgtaacggacccgtaaaccgtaccggtaacttagtttaccgttagtcggtacgtaacggtaaggttaccgtttaacggttccggtacggttcgtttacggtttttaccgg

SEQ ID NO: 349454 - DNA, 605 bp, Homo sapiens
  misc_feature: GZ8MTXP02FZD37.45.37.D04.1.454.CMB.2.raw
  modified_base (279)..(279): a, c, t, g, unknown or other
  misc_feature (279)..(279): n is a, c, g, or t
  modified_base (559)..(559): a, c, t, g, unknown or other
  misc_feature (559)..(559): n is a, c, g, or t
  modified_base (566)..(566): a, c, t, g, unknown or other
  misc_feature (566)..(566): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctgggtgcagtctggggctggaggtgaggaagccgtggggcctcgagtgaaggtctcctgcaaggcttctggctacaccttcaccggcgactacncctccgacgtgggtgccgacgtacggcccccgtggacgaagggcttggagtggagttcggatgacgtacaacccctaaccgagtaggtacggtacaaccaaactagtacgactaacgagtaaagtttacgacgggacgggacggtacgaccctagtacgaaccggaacgtaccgaccgtaccgtacacgacgctaacacgccgtaaccgagtacgtagaccgtgacggaacacggacacgacacgtcacgacgaccgtacgtacctaatttacgttacgngttacgngacgttagttacggttacggtcgtcgttcgttttaccgg

SEQ ID NO: 349455 - DNA, 593 bp, Homo sapiens
  misc_feature: GZ8MTXP02JV388.45.37.D04.1.454.CMB.2.raw
  modified_base (256)..(256): a, c, t, g, unknown or other
  misc_feature (256)..(256): n is a, c, g, or t
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagcccactcccaggtgcagctggtgcagtcgtgggggctggaggtgaggaagccgtggggcctcgagtgaaggtctcctgcaaggcttcgnggctacaccttcaccggcgactatcctccacgtgggtgcgacacggccccctaggaccaaggggcttggagtgggagtggggatgggataccaaaccctaaccaagtggtggacaacaaaactgtcgacaacagtagttacgaggggcagggtcaacgagtacgacgagggacacgtacccagtacagcaacacgcctaaacgagtcgggaagtcctaggacgcgaagacgtacgactaatcgagaaccgtaacgacggtcctaaagttacttcgtagtcggacgtaaggtagtttacggttacccggtggtccgtttcgggtttacttttacgggg

SEQ ID NO: 349456 - DNA, 671 bp, Homo sapiens
  misc_feature: GZ8MTXP02GS0KC.45.37.D04.1.454.CMB.2.raw
  modified_base (253)..(253): a, c, t, g, unknown or other
  misc_feature (253)..(253): n is a, c, g, or t
  modified_base (387)..(387): a, c, t, g, unknown or other
  misc_feature (387)..(387): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcgagtcgtgggctggaggtgaggaagccgtgggctcgagtgaggtctcctgcaggcttcgnggctaccaccttcaccggcactactcctccacgtgggtcgcgacgccggccccgtaggaaccgaagggtcttaggaggtggagtgggagtggaactaccaaaccccgtaacgagtgggtacgacaactaaactntcgacaacgagtaacgttcgagggacgagggtaccacgacgtcgaaccgacgggacaccgtactaacgtacgaccgacctaaaccgaccgtaccccgtaacgtaggtacgggacgtaccgtacggacggaccaacgtaacgtacgaacgtacgttccgaacggaaccgaaaccggtacccggttaaacttagtttttaaacgtacgttaagggtcggtaacggtaacgggttacgtttacggggttaacccgggttaggttcccggttttcggtttttacccgg

SEQ ID NO: 349457 - DNA, 628 bp, Homo sapiens
  misc_feature: GZ8MTXP02JNFPC.45.37.D04.1.454.CMB.2.raw
  modified_base (378)..(378): a, c, t, g, unknown or other
  misc_feature (378)..(378): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctccgtgcgaaggcttcgtggctacaccttcgaccggcgactatcctccgacgtgggtgccgacgacggccccgtggaccaagggcttggagtggagtgggatggatccaaacccctacagtggtacggacaacgaaactntcgacacgaagtaagtttacgagggtcaggggtcaaccgagtacggaccgaaggggacaccggtaccaacgtcgacgacaaccgacgtaccctacgagttacggacgcgtagacgcgaagacgttaggaacacgttacgacggacggaccgaccgggtaccttaacgtttacgttaacgttggtacgaacggtaacgggttacgttacggggtttaaccggtcgggttccgttttacggttttaacccgg

SEQ ID NO: 349458 - DNA, 698 bp, Homo sapiens
  misc_feature: GZ8MTXP02GOP29.45.37.D04.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcgtgggcctnagtgagtctctgcaggctcngctacncctcaccggcactatctccacgtgggtgccgacgacggcccccgtggacgtaagggtctttggaggtgggagtggggatgggaactaccctaaacccgtaaactaaggtgggtacggaccaaaactaaaaccttagtcggaccaacgtaacggttaaacggtttccgagggggacgtaacgggggtaccaaccgtagacgaaccggtacgggaaccctaccggtcccaagtaccgaacgaccaacgacggaccccttaacgaggttacgggaacgccggtagaacgaacgaacggacgtacggacctacgtacgtacggaaccgaccgtaaccgggtacctttaaacgttttacgttaccgttaaggtccgtacgggtaaaggtttacggtttaacgggtttccggttacggggttaccgttttcgggttttacccgtttttaaccgggg

SEQ ID NO: 349459 - DNA, 615 bp, Homo sapiens
  misc_feature: GZ8MTXP02JVT7G.45.37.D04.1.454.CMB.2.raw
  modified_base (363)..(363): a, c, t, g, unknown or other
  misc_feature (363)..(363): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggctcagtgaaggtctctgcaggcttcgtggctacaccttcaccggcgactatcctccacgtgggtgcgacacggcccctggacaagggcttgagtggatgggatggataccaaccccctaacaagtggtggcaacaaactntcgacaacgagtaagtttacgaggggcgacggggtccacgatacggaccgaggggaccacgtaccacgtcacgaccaacgacgacccgtacagtagggacgcgtacgagacgaacgactagaaccgattccgtacggaccgaaccgtaccgggtaccttaacgttttacgttaaccgttggtacggtaaccggtaacgggtacgtttcggggtttaacccgggtcggtttaccgtttcgggtttttacccgg

SEQ ID NO: 349460 - DNA, 582 bp, Homo sapiens
  misc_feature: GZ8MTXP02FUVNZ.45.37.D04.1.454.CMB.2.raw
  modified_base (354)..(354): a, c, t, g, unknown or other
  misc_feature (354)..(354): n is a, c, g, or t
  modified_base (374)..(374): a, c, t, g, unknown or other
  misc_feature (374)..(374): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctcctgcaggcttctggctacaccttcgaccggcgactatcctccacgtgggtgcgacgacggccccgtggacgaagggcttggaggtggagtgggatggactaccaacccctaanaagtggtggacaacaaactntgacacgagtaagtttcgagggcagggtcacagcgacgaggacactcatcacgacacacgccctacagtgggacgtcgaggagtacgaagttacgacggaactactacggacgaaccgaccgtaccggtacctaagttttacgttacgtagtcggaacggtaggtacgtttcgggtttaccggtcggttccgtttggtttttacccgg

SEQ ID NO: 349461 - DNA, 580 bp, Homo sapiens
  misc_feature: GZ8MTXP02JFCH0.45.37.D04.1.454.CMB.2.raw
  modified_base (436)..(436): a, c, t, g, unknown or other
  misc_feature (436)..(436): n is a, c, g, or t
  modified_base (442)..(442): a, c, t, g, unknown or other
  misc_feature (442)..(442): n is a, c, g, or t
  modified_base (455)..(455): a, c, t, g, unknown or other
  misc_feature (455)..(455): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaggcttctggctacaccttcaccggcgactatctccactgggtgcgacacggcccctggacgaaggcttgagtggagtgggatggataccaaaccccctaacaagtcggtacggcaacgaaactgtgacaacgagtaacgtttcgaggcgagggtacaccagtacgacgaggacaccgtcatcgacgcacacncctagntaggagctagganacagactagactactcgtacgaccgaacgtaccggtaaccctagtttaacgttaaccgttgtcggtaagtacgggtacgtttacgggtttaccgggttcggttaccggtttcggtttttacccgg

SEQ ID NO: 349462 - DNA, 616 bp, Homo sapiens
  misc_feature: GZ8MTXP02JRDGW.45.37.D04.1.454.CMB.2.raw
  modified_base (253)..(253): a, c, t, g, unknown or other
  misc_feature (253)..(253): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccgaggtgcagctggtgcagtcgtgggctggaggtgaggagccgtgggcctcgagtgaggtctctgcaggtcttcgnggctacaccttcaccggcactatcctccgagtgggtcgccgacgaccggccccgtagggaaccgaagggtcttggaggtggtagtgggatggactaccaaaccccctaagaagttggacgactaaacgaaacttgcgacaagaagttagttacggagggacgagggtaccacgagtacgaccggaggacaccgtacanacganaccaacgcacctaacgagtacgggacgacgtaggacgacgaacgactagactacgttacgacgaccgacgtaccggtaccttaatttacgtacgttggtacggaacggtaggttaacgtttacggggttccggttaggttccgttttacggttttacccg

SEQ ID NO: 349463 - DNA, 629 bp, Homo sapiens
  misc_feature: GZ8MTXP02I6P85.45.37.D04.1.454.CMB.2.raw
  modified_base (239)..(239): a, c, t, g, unknown or other
  misc_feature (239)..(239): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (289)..(289): a, c, t, g, unknown or other
  misc_feature (289)..(289): n is a, c, g, or t
  modified_base (472)..(472): a, c, t, g, unknown or other
  misc_feature (472)..(472): n is a, c, g, or t
  modified_base (508)..(508): a, c, t, g, unknown or other
  misc_feature (508)..(508): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagcgtggtgcagtcgtggggctggaggtgaggagcgtgggcctgagtgaggtctcngcaggctgnggctacnccttcgaccggcactactcctaccacgtgggtcncgacgccggcccctaggacgaaggcttggagtggagtgggataggactaccaaaccccgtaacgaaggttcggacggactaaacctaaaacgtagtacgacctaaacgtaagttaaacgttcggaaacggggtcgaagggtaccaaccgtaagccggaacgtaacggggacctaccgtaccanacgaacgcgaaaccaggtacccaaagtagacggganccgagacgaacgacggtaactagaacgtacacggtacgaaccgtaccgaccggtaaccttattacgtagtcgaggaacgtaggtacgttcggttacgtcggttaccgtttaggttttaccg

SEQ ID NO: 349464 - DNA, 668 bp, Homo sapiens
  misc_feature: GZ8MTXP02JUCZH.45.37.D04.1.454.CMB.2.raw
  modified_base (516)..(516): a, c, t, g, unknown or other
  misc_feature (516)..(516): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactcccaggtgcagctggtgcagtcgtgggctggaggtgaggaagccgtggggcctcgagtgaaggtctcctgcaaggtcttcgtggctacaccttcgaccggcgactatcctcacgtggtcgcgaccgcggccccgtaggaccgaagggtccgttaggagtggtagtggggaattggactacaaaacccccgtacgaagtgggtacgacctaaacaaacctgtacgacgtacctaaaggtaagtttacccgaggggtacgtaacggggtcctaaaccgtagtaccggaaccgacggggacctaccggttacccagtaccgacgaccaacgttacggaccctanagttaggacggtaccagaccgaacgacggaccgtaacgactacgtaccgacgaaccgaccgtaaccgttactttaaacgttacgttacgtacgtacgtaacggtacggttaccgtttacggttaccggtacggtttcggtttacgtttaccg

SEQ ID NO: 349465 - DNA, 594 bp, Homo sapiens
  misc_feature: GZ8MTXP02GDKOG.45.37.D04.1.454.CMB.2.raw
  modified_base (261)..(261): a, c, t, g, unknown or other
  misc_feature (261)..(261): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctggaggtggaggaagccgtggggcctcgagtgaaggtctcctgcaggcttctggctacnccttcaccggcgactatctccacgtgggtgcgacacggccccctggacaagggcttgagtggagtgggatggataccaaaccccctaacaagtggtggacaacaaactntgacanagtaagtttcgagggcagggtcacgatagacagggacacgtcaatcagacacgacgcctacagtaggagcctgagcgagactacggactagttacgacggaaccgaaccggacccggtaccttaagtttttaaccgtaacgttcggttacggaacggtaacgggttacgtttcggggtttaaccgggttcggtcggttttacgggttttttaccccgg

SEQ ID NO: 349466 - DNA, 646 bp, Homo sapiens
  misc_feature: GZ8MTXP02GBT62.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctgggtgcagtcgtggggctggaggtgagggaagccgtggggcctcgagtggaggtctcctgacaggtcttcgtggctaccaccttcgaccggcgtactactcctccacgtgggtcgccgacgaccggccccgtaggacgaaggtcttggagtggagtggggatggaactaccgaaaccctaaacgtagtagggtacggaacaaactaaactagtacgacaacgtaaagtaagtttacggaaggggtaccgagggtacccaacgaacgtacgaccggaaacgggacaccggtacactacgagacctaaccgacgactaaccgagtacgggagtacgagacgacacggaactacggaactcgtacacgaaccgtaccgacgtaaccgttaattttactaacgtgtacggaagtaggtacgtttacgggtttaccggtcggttacggtttcggtttttaccgg

SEQ ID NO: 349467 - DNA, 515 bp, Homo sapiens
  misc_feature: GZ8MTXP02IYU2P.45.37.D04.1.454.CMB.2.raw
  modified_base (358)..(358): a, c, t, g, unknown or other
  misc_feature (358)..(358): n is a, c, g, or t
  modified_base (393)..(393): a, c, t, g, unknown or other
  misc_feature (393)..(393): n is a, c, g, or t
  modified_base (439)..(439): a, c, t, g, unknown or other
  misc_feature (439)..(439): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctgggggcctcagtgaaggtctctgcaaggcttctggctacaccttcaccggcgactatctccactgggtgccgacacggccccctggaccaagggcttgagtggatgggatggatcaacccctaacatggtgcacaaactntgacacagaagttcaagggtcagggtcaaccgtanagaccagggactacggtccaatcagcacacgcctacatcggagtcngagcagactgacatctgacacacggactatttacactgtagcgtaggattcggttaccggtggtcttggttttccg

SEQ ID NO: 349468 - DNA, 638 bp, Homo sapiens
  misc_feature: GZ8MTXP02G4OVD.45.37.D04.1.454.CMB.2.raw
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagccccactcccaggtgcagctggtgcagtcgtgggggctgaggtgaggagccgtggggcctcagtgaaggtctcctgcaggcttctggctacaccttcaccggcgactatctccacgtgggtgcgacgacggccccctggacgaaggggcttaggaggtggagtggggatggataccgaaacctaaccgaagtggtaggacaacgaaactagtcgacaacgaaggtaaagtttcgaggggccgagggtaccaccgagtagaccgaagggacacgtccgatacagacaacgacgacctaacagtaggaacgtcgtaggagacgaaggactcgaactacgtcgtacggaaccgaccgaaaccggtccttaaatttaacgtttaccgtaggttacggtaaccggtaagggttaacgtttaccgggttttaccggggtacggttccggttttacgggttttcccgtttttacgggg

SEQ ID NO: 349469 - DNA, 715 bp, Homo sapiens
  misc_feature: GZ8MTXP02IN3FL.45.37.D04.1.454.CMB.2.raw
  modified_base (249)..(249): a, c, t, g, unknown or other
  misc_feature (249)..(249): n is a, c, g, or t
  modified_base (375)..(375): a, c, t, g, unknown or other
  misc_feature (375)..(375): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaacgccgtggggcctcagtgaggtctcctgcaggcttcnggctacaccttcaccggcgactatcctaccacgtgggtgccgacaggccccctggaaccgaaggacttggagtgggagttcgggagtggactacaaccctaacaagtggtaggacaacaaacttancggtacacgaaggtaaacgttttccgaagggggtacgtacggggtaccaaccgaacgttacgaacccggaaacggggacccgtaaaccggtccccgaacttaccgaaacgggacccaacccgaaacgggtaccccttaaaccgaaggttacggggtaccggtaccgtaagaccgggacaaacggtaaccgttacgggaaccgtaactacgttacggaaaccggacccgtaaaccgggtaccctttaaattttaaccgttagttaccggttaggacggtaaggttacgttacgggtttaaacgggttcggtccggtttcggtttacggtttttaacccggg

SEQ ID NO: 349470 - DNA, 526 bp, Homo sapiens
  misc_feature: GZ8MTXP02I6LY8.45.37.D04.1.454.CMB.2.raw
  modified_base (368)..(368): a, c, t, g, unknown or other
  misc_feature (368)..(368): n is a, c, g, or t
  modified_base (413)..(413): a, c, t, g, unknown or other
  misc_feature (413)..(413): n is a, c, g, or t
  modified_base (441)..(441): a, c, t, g, unknown or other
  misc_feature (441)..(441): n is a, c, g, or t
  modified_base (443)..(443): a, c, t, g, unknown or other
  misc_feature (443)..(443): n is a, c, g, or t
  modified_base (456)..(456): a, c, t, g, unknown or other
  misc_feature (456)..(456): n is a, c, g, or t
tcagacgcgatcgacacgaccggtgctcgatttagtagcatactgttggggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaggcttctggctacaccttcaccggcgactatcctccactgggtgcgacacggcccctggaccaaggggcttggagtggagtgggatggatacgaacccctaacaatggtaggacacgaaactntcgacacagaagtttcaggggcagggtcaccagtcgacagggacnccgtcatcagcactacgctacagtggancngagcagacctganactcgacgacgacacggacctatttacacgtgtagcgagacgttcggttaccggtggtcgttcgttttcg

SEQ ID NO: 349471 - DNA, 549 bp, Homo sapiens
  misc_feature: GZ8MTXP02IRRLQ.45.37.D04.1.454.CMB.2.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (440)..(440): a, c, t, g, unknown or other
  misc_feature (440)..(440): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtgggcctnagtgagtctctgcagctntggctacaccttcaccggcgactatcctccacgtgggtgcgacgacggccccctggaaccgaagggtctttggacgtgggagtgggatggactaccgaacctaacagtggtgacaacaaactatgcaacagtaagttcgagggcagggtcacatcgacgaggacacgtccatcgaagcacacgacctacgacgtggacncgtagacgacgaggacctagactatcgacggaacgaccgaccggtacctaatttactacgtagtgacgtaagtagttcggttacggtgtcgtttacggtttctttacgg

SEQ ID NO: 349472 - DNA, 591 bp, Homo sapiens
  misc_feature: GZ8MTXP02HYWXJ.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctaccaacaataagaactacttagcttggtaccagcaagaaccaggtcagcctcctaagctagctcatttaccgtgggacagtccgtaccccggggaagtcccggggtcccccctagaccgtattcagtggcagggcgggtctggggaccagtactttcacctctcacccatcacgcacgccgtgacaggctagaaagtacgtagtggtccgttagtttacgtgtcgtagtctagactaaattattaatttattacttcccgttaccgtaccgttttccggacccgttacggggaacccctaaaaggtaggtaattaacgtacaaaaccgtacgtggtacggactaccg

SEQ ID NO: 349473 - DNA, 595 bp, Homo sapiens
  misc_feature: GZ8MTXP02I0JOU.45.37.D04.1.454.CMB.2.raw
  modified_base (456)..(456): a, c, t, g, unknown or other
  misc_feature (456)..(456): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttctggctacaccttcgaccggcgactactctccacgtgggtcgcgacgacggccccgtggaccgaagggcttggaggtggagtgggattgggaactccaaacccccgtaacgaaagttgggtacggacaaaccgtaaaactgtacgacaacgagtaacgtttcgagggcgaagggtcaccagtacgaccgagggacaccggtctacncacgaccaacgaccggacctaacgtaagtcgggaacgctacgacggacaggactgaacatcgtacgacgaccgacgtctactttactacgtcgtaggcgtaggtacttacggttacggtcggtcgttcggtttttaccg

SEQ ID NO: 349474 - DNA, 653 bp, Homo sapiens
  misc_feature: GZ8MTXP02IVTWT.45.37.D04.1.454.CMB.2.raw
  modified_base (287)..(287): a, c, t, g, unknown or other
  misc_feature (287)..(287): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggagccgtggggcctcgagtgaggtctctgcaggcttctggctacacttcaccggcgtactatcctccgacgtgggngtcgacgacggcccctaggaccgaagggtcttggaggtggagttgggatggactaccaacccctaacgaagtcgggtacgactaacgtaaactgtacgacgtaaacgtagtaacgggttttacgacgggggtacgtaacgggggttcccaaaccgtacgtacggaaacccggacggggaacctacccggtactaacgtacgacgtaccgaaactacgaccttaacgacgttagggacgtcgtacgaggacctaggtacctacgaaactcgtacgtacgaaccgtacgaccggttaccttatttaacgttacgtcgtacgaacggtagtacgtttacggttacggtcggtcgtttacggttttaccg

SEQ ID NO: 349475 - DNA, 616 bp, Homo sapiens
  misc_feature: GZ8MTXP02F524L.45.37.D04.1.454.CMB.2.raw
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (277)..(277): a, c, t, g, unknown or other
  misc_feature (277)..(277): n is a, c, g, or t
  modified_base (380)..(380): a, c, t, g, unknown or other
  misc_feature (380)..(380): n is a, c, g, or t
  modified_base (496)..(496): a, c, t, g, unknown or other
  misc_feature (496)..(496): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtgggcctcgagtgaggtctcctgcagcttcgnggctacnccttcgaccggcgactctcnccacgtgggtgcgacgaccggccccgtggacgaagggtcgttaggacggtggagtgggagtggactaccaaaccccgtaacaagtgggtacgacaacaaactntgacaacgagtaacgtttcgagggacgagggtcaccgagtacgacgacgggacaccgtacgactcgacgcaaccgacgacctacgagtacgggacgtaccgagacgacgacgacgnggaacacttcgacgaccggacgtaaccgtaccgttatttacgttacgtacggttaggtaacgtaacggtacggtttacgggtttaccgggtacggtttccggtttacggtttttacccgg

SEQ ID NO: 349476 - DNA, 617 bp, Homo sapiens
  misc_feature: GZ8MTXP02JQ0DF.45.37.D04.1.454.CMB.2.raw
  modified_base (186)..(186): a, c, t, g, unknown or other
  misc_feature (186)..(186): n is a, c, g, or t
  modified_base (255)..(255): a, c, t, g, unknown or other
  misc_feature (255)..(255): n is a, c, g, or t
  modified_base (296)..(296): a, c, t, g, unknown or other
  misc_feature (296)..(296): n is a, c, g, or t
  modified_base (384)..(384): a, c, t, g, unknown or other
  misc_feature (384)..(384): n is a, c, g, or t
  modified_base (463)..(463): a, c, t, g, unknown or other
  misc_feature (463)..(463): n is a, c, g, or t
  modified_base (499)..(499): a, c, t, g, unknown or other
  misc_feature (499)..(499): n is a, c, g, or t
tcagacgcgatcgacacgaccggtgctcgatttagtagcatactgttgggtttgggggagagcatcacccagcaaccacatctgtcctctagagaatccccctgagagctccgttcctcaccatggactggacctggagatcctcttcttggtggcagcagccaacaagacgcccactcccaggtncagctggtgcagtcgtggggctggaggtgaggagccgtgggcctgagtgagtctcctgcgaggcttcgnggctacaccttcgaccggcactactcctccacgtggggtcncgaccgacggcccctaggaccgaagggcttaggaggtggagtgggatggactaccccgaaccctaagagtgggtagacaactaacttnacgacaacgtaaggtaacgtttacggacgggacgtacgggtacaaccgagcggaaccggaagggtacccaacgtaccanccgaacgacctaacgacgaccctagagacggggacncgagaacgaccaaggtacctaggacaacgttcgacgaaaccgacggacgtaccttatttaccgtagtagtaacggacgaggttacgttcggtttaaccggttcggtactttttccggg

SEQ ID NO: 349477 - DNA, 565 bp, Homo sapiens
  misc_feature: GZ8MTXP02GS463.45.37.D04.1.454.CMB.2.raw
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
  modified_base (294)..(294): a, c, t, g, unknown or other
  misc_feature (294)..(294): n is a, c, g, or t
  modified_base (365)..(365): a, c, t, g, unknown or other
  misc_feature (365)..(365): n is a, c, g, or t
  modified_base (421)..(421): a, c, t, g, unknown or other
  misc_feature (421)..(421): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagcgtggggcctnagtgaaggtctcctgcaaggcttcgngctaccaccttcgaccggcgactatcctccacgtgggtncgacacggcccctggacaagggtcttgagtggatgggatggatacccaacctaacagtggtgacacactangacacaagaagtttcgagggtcagggtcacctagacgaccagggacacgtaccaanacgacgacacgacactagagaggacgcgagacgacgacgacgtacgacgtacgtacgacgaaacgacgtacggtacttacgtttaacgtacgtgaacggtacggtaacggttacgttacggtttaccggtcggtttcgtttcgg

SEQ ID NO: 349478 - DNA, 631 bp, Homo sapiens
  misc_feature: GZ8MTXP02G86KW.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggagcgtggggcctcagtgaaggtctctgcaaggtcttctggctacgaccttcgaccggcgacgtatcctccacgtgggtgcgacgacggccccgtaggacgaaggtcgttaggaggtggagtgggatggactacaaacccccgtaacgagtcggtacgacaacgaaactatcgacaacgagtaacggtttcgaaggggaccgacgggtaccacgtagtacgaacgacggggtacacgtaccatacgacgacaacgacgacccttagagtaggagaccgtaggaacgcgacggtactacgaacgtactcgtaacggaaccggtaccaccggtaacttaacgtttaacgttacgtacggtagtaaccgggtaggttaacgttcgggtttaaccggtcggttcggtttacggtttttaccggg

SEQ ID NO: 349479 - DNA, 618 bp, Homo sapiens
  misc_feature: GZ8MTXP02H22WB.45.37.D04.1.454.CMB.2.raw
  modified_base (251)..(251): a, c, t, g, unknown or other
  misc_feature (251)..(251): n is a, c, g, or t
  modified_base (348)..(348): a, c, t, g, unknown or other
  misc_feature (348)..(348): n is a, c, g, or t
  modified_base (442)..(442): a, c, t, g, unknown or other
  misc_feature (442)..(442): n is a, c, g, or t
  modified_base (450)..(450): a, c, t, g, unknown or other
  misc_feature (450)..(450): n is a, c, g, or t
  modified_base (463)..(463): a, c, t, g, unknown or other
  misc_feature (463)..(463): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggctggaggtgaggagccgtggggcctgagtgaggtctcgtgcaaggtcttcnggctacaccttcaccggcgactatcctccactgggtgcgacgacggcccctggacgaaggtcttgagtggagtgggagtggataccaaacccctaanaagtggtcggacaacaaaactgtgacacgaagtaagtttcgagggtcgagggtaccacagtcgaccgaggactaccgcaagtacagacacgacncctaacgnttacgggagtacngacgacgtaacgaccgttagaactacgttacgacgaaccgaaccggaaccggtaacccttaagtttttaaccgtaattcggtacggtaaccggtaagggtacgtttaccggggttttaacggtacggtttccggttttaccggtttttcccgggg

SEQ ID NO: 349480 - DNA, 606 bp, Homo sapiens
  misc_feature: GZ8MTXP02JNFCI.45.37.D04.1.454.CMB.2.raw
  modified_base (251)..(251): a, c, t, g, unknown or other
  misc_feature (251)..(251): n is a, c, g, or t
  modified_base (258)..(258): a, c, t, g, unknown or other
  misc_feature (258)..(258): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcaggctnggctacncctcaccggcactatcctccagtggtgcgacgacggcccctaggaccaaggggtcttggaggtggagtggggatgggaactaccaaacccctaacgagtcggtacgacaacaaactgtacgacacgtagtacgttcgacgggcgacggtcacgagtacgacgagggacctacggaccagtacacgaccacgacgacctacgtagtacggacgacgtagacgacgacgtacgtacgaactacgtacgtacggaacgaccgtaccggtaactttacgtttaacctcgtggtacgtaacggtaggttacgttcgggtttacggtcgtttaccggtttacggttttacccgg

SEQ ID NO: 349481 - DNA, 528 bp, Homo sapiens
  misc_feature: GZ8MTXP02FSTXU.45.37.D04.1.454.CMB.2.raw
tcagacgcgatcgacacgaccggtgctcgatttagtagcatactgttggggtttgggggcatcaccccagcaaacacatctgtcctctagagaatccccctgagagctccgttcctcaccatggactggacctggaggatcctcttcttggtggcagcagccacaagagccccactccccaggtgcagctggtgcagtctgggggctgaggtgaggaagcctgggggcctcagtgaaggtctcctgcaaggcttctggctacaccttcaccggcgactatctccactggggtgcgacaggccccctggacaagggcttgagtggatggggatggatcaaccctaacagtggtgcacaaaactatgcacagaagtttcagggcagggtcacatgaccagggacacgtccatcagcacagcctacagtggagtcgtagacgcagactgacatctagacgacacggcctaatttacttactgtgcgaaggtacttacggtttaccggtggtcgttcggtttccttttacgg

SEQ ID NO: 349482 - DNA, 607 bp, Homo sapiens
  misc_feature: GZ8MTXP02FSL43.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctgaggtgaggaagccgtggggcctcgagtgaaggtctcctgcaaggcttctggctacaccttcaccggcgactatctccactgggtgcgacacggcccctggacaagggcttggagtggagtgggatggatacaacccctaacaagtggtagacaacaaactatgacaacgaaagtaagtttacgaacggggtacgagggtaccaaccactacggaccgaacggggaccaccggttccaatcacgcaacacgaccctaacagtaggacgtacacgagacgaacgaacgtacgaacactacgtacggacgaccgaaccggtaccctaattttacttaccgttagttcgaaccggtaggttacgttacggtttaaccgggtcggttacgtttacggtttttcccgg

SEQ ID NO: 349483 - DNA, 509 bp, Homo sapiens
  misc_feature: GZ8MTXP02GSQA9.45.37.D04.1.454.CMB.2.raw
  modified_base (351)..(351): a, c, t, g, unknown or other
  misc_feature (351)..(351): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaggtctctgcaggcttctggctacaccttcaccggcgactatctccactgggtgcgacacggcccctggacagggcttgagtggatgggatggatcaacccctaacaatggtgcaacaaactntgacacagtaagtttcgagggcagggtcaccagtcgacgagggacacgtcatcagcacagacctacagtggagctgagcagactgacatctagacgacacggacctatttactacgtgtgcgagtagttcggttaccggtggtcgtttcggttttccg

SEQ ID NO: 349484 - DNA, 618 bp, Homo sapiens
  misc_feature: GZ8MTXP02H9ROD.45.37.D04.1.454.CMB.2.raw
  modified_base (251)..(251): a, c, t, g, unknown or other
  misc_feature (251)..(251): n is a, c, g, or t
  modified_base (354)..(354): a, c, t, g, unknown or other
  misc_feature (354)..(354): n is a, c, g, or t
  modified_base (374)..(374): a, c, t, g, unknown or other
  misc_feature (374)..(374): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaagcgtgggcctgagtgaggtctctgcaggtcttcnggctacaccttcaccggcgactactctccacgtgggtgcgacgacggcccctaggacgaagggtcttggaggtcggagtgggatggactaccaaacccctaanagtggcggacaacgaaactntcgacaacgtagtaagttcgagggcacgggtcacgagtacgaccgaggaccacgtacatacgagaccaacgaccgcctaacgtagtcggaagccgtacggaacgacgaagaccttacggaactagttaccgacggaacccgaccgaccggtaacccttaattttacgtaccgttggtacggtaacggtaacggttacgtttaccgggtttaccgggtcggtttcgtttaccggggtttttccgg

SEQ ID NO: 349485 - DNA, 634 bp, Homo sapiens
  misc_feature: GZ8MTXP02HBM0I.45.37.D04.1.454.CMB.2.raw
  modified_base (252)..(252): a, c, t, g, unknown or other
  misc_feature (252)..(252): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctgggctgaggtgaggaagccgtggggcctcgagtgaggtctctgcaaggcttcnggctactacctcaccggcgactatcctccacgtgggtgcgacgacggcccctggacaagggcttggagtggagtggggatgggactaccccgaaaccctaagaagtgggtgaccaactaacctagtcgacaacgtagtaagtttcgacggggtacgacgggtaccaccgtagtacggaccgaggggaccacgtccatacgacgaccgaactacggcctaacgagtacgggaacgtccgaggacgacgaacggtaactacggaactacgttaccgaacggaccggaaccggtaccggtaacccgtttaatttaaccgttacgtaaggttcggaacggtaggttacgtttacggtttaccgggtcggttaccgtttttccgggg

SEQ ID NO: 349486 - DNA, 732 bp, Homo sapiens
  misc_feature: GZ8MTXP02HPXLT.45.37.D04.1.454.CMB.2.raw
  modified_base (224)..(224): a, c, t, g, unknown or other
  misc_feature (224)..(224): n is a, c, g, or t
  modified_base (347)..(347): a, c, t, g, unknown or other
  misc_feature (347)..(347): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggagcctgggcctnagtgaggtctcctgcaggcttctggctacaccttcaccggcgactatctccacgtgggtgcgacacggcccctggacaagggcttggagttggagtgggatgggataccaaaccccccgtaanaatcgggtaggacaaaccaaaactcgtaggacaaacgtaacggttaaagtttaccgaagggggtccgaaacgggggttccaaacccgtacgtacggaaacccgaacgggggaaaccctaaccgggttacccaaacgttaccgaacgggacccaaccgaaaccggtacccttaaaccgaagttcggggaacgttccgtaggaaacggacccgtaagggaacccttagggaaccgtaaacttcccggtacggaaacccgggtaaaccgaacccgggtacccgtttaaacttttaagttaaccgttgggtacggtaaccgggtaaagggtacgttttacgggtttaacccggggtggtttaccggttttacgggttttttaccccggg

SEQ ID NO: 349487 - DNA, 622 bp, Homo sapiens
  misc_feature: GZ8MTXP02IJG11.45.37.D04.1.454.CMB.2.raw
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
  modified_base (350)..(350): a, c, t, g, unknown or other
  misc_feature (350)..(350): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctgaggtgaggagccgtgggcctnagtgaggtctcctgcaaggcttcgnggctacaccttcaccggcgactatcctccacgtgggtcgcgaccacggcccctggaacgaaggtctggagtggagtgggatggactaccaaacccctaanaagtggtacgacaaacaaactgtcgacaaacgagtaagttcgaagggcgacggtcaacgagtacgaccgacggactacgtacacgtacacgaccacgacgtacctaacgtacggtggacgtacgtaggaacgccgaaagtacacgactacgtactacggaaccgaacgaacccggttacttaaacgttttaacgtaccgttaggtacggtaaccggaaggttaacgtttcgggtttaaccgggttcggttccggttttacggtttttcccgg

SEQ ID NO: 349488 - DNA, 631 bp, Homo sapiens
  misc_feature: GZ8MTXP02JIXKF.45.37.D04.1.454.CMB.2.raw
  modified_base (509)..(509): a, c, t, g, unknown or other
  misc_feature (509)..(509): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggaagcgtgggcctgagtgagtctctgcagctgtggctacacctcgaccgcgactatctaccacgtggtcgcgaccgacggccccgtggaacgaaggtctggagtggagtgggagtggaacgtaccaaaccccgtaagaagtggtacggactaaacgaaaacgttagacgaccgtaaacgaaggtaaacgtttacggacgggtacgaacgggttaccaaaccgtaagaccggaaccgaacgggggaacctaccggtacctaacgtacgacgaccaacgacgacctacgaagtgggacncgtacggagacgaggtactacggacacttcccgagaccgaacgaccggtacttaactttacgtaccgttggtacggaacggtaggtacgttacggttacgtcggtcgtttacgttttaccgg

SEQ ID NO: 349489 - DNA, 676 bp, Homo sapiens
  misc_feature: GZ8MTXP02FXLT7.45.37.D04.1.454.CMB.2.raw
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggacgccgtggggcctcagtgaaggtctcctgcgaaggtcttcgtggctaccaccttcgaccggcgactatcctccgacgtgggtcgcgacgacgggcccctaggacgaagggtcttaggaggtggacgtggggatggaactaccaaaaccctaacgtaagtcgggtagacaaacgtaaacgtatcgaccaaacgtaggttaaagttcgaaggggcgtaacgggtaccaaacgtagtacggaacccgaaggggaaccctaccggtaccaactcgaaacgaccgaacctaacggacccttaacgtaggtacgggaacggtccgtagaccgacgaacggtactacggaacctaagtccgtaacgggaaaccgaccgaccggtaacctaagttttaaactcgtaggtacgaccggtaagtacgtttacgggttacccggtggttcgtttacggtttccgtttaacggg

SEQ ID NO: 349490 - DNA, 508 bp, Homo sapiens
  misc_feature: GZ8MTXP02FH4A0.45.37.D04.1.454.CMB.2.raw
  modified_base (361)..(361): a, c, t, g, unknown or other
  misc_feature (361)..(361): n is a, c, g, or t
  modified_base (476)..(476): a, c, t, g, unknown or other
  misc_feature (476)..(476): n is a, c, g, or t
  modified_base (495)..(495): a, c, t, g, unknown or other
  misc_feature (495)..(495): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctgggggcctcagtgaaggtctcctgcaaggcttctggctacaccttcaccggcgactatctccactgggtgcgacaggccccctggacaaggggcttgagtggatgggatggatcaaccccctaacaatggtggacacaaactntgcacagaagtttcagggcaggggtcaccatgaccagggacacgtccatcagcacacgcctacatgggagctgagcgagactgacatctacgacgacacggcctaattacttacngtgcgagatcgttaccggngtacgtgtttccg

SEQ ID NO: 349491 - DNA, 607 bp, Homo sapiens
  misc_feature: GZ8MTXP02GBLVD.45.37.D04.1.454.CMB.2.raw
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcgaccggcgactatcctccacgtgggtgcgacgacgggccccctggacaaggggcttgaggtgggagtggggtactgggtactaccgaaccctaacgaagtggtacggactaacgaaaactgtgcaacgagtaagtttcgaggggtcagggtacacagtcgaacgagggacacggcaatcagcacgagcctaacagtcggagtcgtagacgacgaagcgtacggacctagtccgtacggaccgacgtaccggtactaacgtttacgtaccgttggtaccgacgtaagggttacgttacgggtttaccgggtggtaccgtttaggggttttcccttttaacgggg

SEQ ID NO: 349492 - DNA, 615 bp, Homo sapiens
  misc_feature: GZ8MTXP02H26JN.45.37.D04.1.454.CMB.2.raw
  modified_base (412)..(412): a, c, t, g, unknown or other
  misc_feature (412)..(412): n is a, c, g, or t
  modified_base (430)..(430): a, c, t, g, unknown or other
  misc_feature (430)..(430): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcgtggggcctcgagtgaaggtctcctgacaaggcttcgtggctacaccttcgaccggcgactatcctccacgtggtcgcgacgacggccccgtggaacgagggtcttggagtggagtgggatggatacaacccctaagaagttggacgacaacaaactgtcgacaacgagtacgttcgaggacgacgggtcaacgtanacgaccgagacacgtcanacacgcacacgacctaacgagtaggacgccgtagacgacaacgtacgacggactacttacggtacgaaccggaaccgaaccgggtacccttaaagtttttacgtaaccgtttggacggtaaccgggtaggttaacggtttaccgggtttaaccggttcggttacgttttaccgggtttttcccgg

SEQ ID NO: 349493 - DNA, 577 bp, Homo sapiens
  misc_feature: GZ8MTXP02GBK0L.45.37.D04.1.454.CMB.2.raw
  modified_base (434)..(434): a, c, t, g, unknown or other
  misc_feature (434)..(434): n is a, c, g, or t
  modified_base (461)..(461): a, c, t, g, unknown or other
  misc_feature (461)..(461): n is a, c, g, or t
  modified_base (484)..(484): a, c, t, g, unknown or other
  misc_feature (484)..(484): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtggaggaagccgtggggcctcgagtggaaggtcctccgtgcgaaggcttcgtggctacaccttcgaccggcgactatcctccacgtgggtgcgacgacggcccctggacgaggcttgagtggagtgggagtggactaccgaaacccctaacgaagtcggtaggacaaacgaaactgtacgacaagacgtaagttcgagggctagggtcacatcgaccgagggacncgtacatcacgcacacgacctacgagnggatcgagacgcaagactgaacnttcgagaccgtacgaccggtactaatttacttacgtggtagaacggtagtacgttacgggtttacggtcggttcggtttcggtttttacccgg

SEQ ID NO: 349494 - DNA, 603 bp, Homo sapiens
  misc_feature: GZ8MTXP02HFX6G.45.37.D04.1.454.CMB.2.raw
  modified_base (263)..(263): a, c, t, g, unknown or other
  misc_feature (263)..(263): n is a, c, g, or t
  modified_base (369)..(369): a, c, t, g, unknown or other
  misc_feature (369)..(369): n is a, c, g, or t
  modified_base (447)..(447): a, c, t, g, unknown or other
  misc_feature (447)..(447): n is a, c, g, or t
  modified_base (461)..(461): a, c, t, g, unknown or other
  misc_feature (461)..(461): n is a, c, g, or t
  modified_base (475)..(475): a, c, t, g, unknown or other
  misc_feature (475)..(475): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtggggcctcgagtgaaggtctccgtgcaggtcttcgtggctacnccttacaccggctactatcctaccgacgtgggtcgacgacgacggtccccctaggacgaagggtcttaggacgtggagtgggatggactacaaaccccccgtaaanacgtggtacggacaacgaaactgtcgacacgagtaagttcgagggcagggtccaacagtgaccgaggaccacgtacancagcacagacctanacgtggatcgaganagaaggactcggaactatccggacgaaccggactacccggtacttaatttaaccgttagtacggtacggaacggttaaagtacggttacggtttaaccgggttcgtcgttttacgggtttttacccgg

SEQ ID NO: 349495 - DNA, 645 bp, Homo sapiens
  misc_feature: GZ8MTXP02GE2IE.45.37.D04.1.454.CMB.2.raw
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
  modified_base (289)..(289): a, c, t, g, unknown or other
  misc_feature (289)..(289): n is a, c, g, or t
  modified_base (379)..(379): a, c, t, g, unknown or other
  misc_feature (379)..(379): n is a, c, g, or t
  modified_base (465)..(465): a, c, t, g, unknown or other
  misc_feature (465)..(465): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggagccgtggggcctnagtgaaggtctctgcaggcttcnggctacnccttcgaccggcgactatcctccacgtgggtcncgacgacggccccgtaggacgagggcttggagtggagtgggatggaataccgtaaaccccctaagaagtgggtacggacaacgaaacttncgacaacgagtaagtttcgaggggcagggtccaacagtacgaccgagggacacgtccactacgacgactacgacgtaccctaacgngtacgggacgtcgacgacgaccgaagtaccgtaggaacctagtaccgtacggaacccgaccggtaaaccgggtacccttaattttaaacgttaaccgttgggtacggtaacgggtaaaggttaacgttttcggggttttaaccgggtcggtttaacccggttttcggtttttaacccggg

SEQ ID NO: 349496 - DNA, 545 bp, Homo sapiens
  misc_feature: GZ8MTXP02IA65F.45.37.D04.1.454.CMB.2.raw
  modified_base (361)..(361): a, c, t, g, unknown or other
  misc_feature (361)..(361): n is a, c, g, or t
  modified_base (440)..(440): a, c, t, g, unknown or other
  misc_feature (440)..(440): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggagcctggggcctcagtgaaggtctcctgcaaggcttctggctacaccttcaccggcgactatcctccacgtgggtgcgacacggcccctggacagggcttggagtggatgggatggatacaacccctaacagtggtgacaacaaactntgacacgagtagtttcgaggggcagggtcaccgatcgacgagggacacgtccatcgagcacacgcctaacgatagggancgtagacgcagactgaactagtctacgacgacacggaccttaatttactacgtgtacgcgtaaggtacgtttacggttaccggtcggttacgttcggtttttccg

SEQ ID NO: 349497 - DNA, 603 bp, Homo sapiens
  misc_feature: GZ8MTXP02FG2ZC.45.37.D04.1.454.CMB.2.raw
  modified_base (377)..(377): a, c, t, g, unknown or other
  misc_feature (377)..(377): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaggcttctggctacacctcaccggcgactatctccactgggtgcgacacggcccctggacaaggggcttggagtggagtggggatggggaactaccaaacccccctaacgaacgtgggtacggacaaccaaaactntcgacaacgagtaaagtttccgagggcgaagggggtacaccgaatggaacccaggggaccaccggtaccatccagccaacgacgccctacagtacgggagctcggaagccaaggacctggaactactcgtacgacgaccaccggaccctaattttaacttactggttcggaacggtagggtaacgtttcggtttacccgggttggtccgtttacggtttttcccgg

SEQ ID NO: 349498 - DNA, 595 bp, Homo sapiens
  misc_feature: GZ8MTXP02IVTUQ.45.37.D04.1.454.CMB.2.raw
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (288)..(288): a, c, t, g, unknown or other
  misc_feature (288)..(288): n is a, c, g, or t
  modified_base (323)..(323): a, c, t, g, unknown or other
  misc_feature (323)..(323): n is a, c, g, or t
  modified_base (348)..(348): a, c, t, g, unknown or other
  misc_feature (348)..(348): n is a, c, g, or t
  modified_base (367)..(367): a, c, t, g, unknown or other
  misc_feature (367)..(367): n is a, c, g, or t
  modified_base (540)..(540): a, c, t, g, unknown or other
  misc_feature (540)..(540): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctcgagtgaggtctctgcaggcttcngctacnccttcgaccggcgactatcctccacgtggtncgacgacggccccgtggacaagggtctgaggtggntgggatcggactacaaccccctaanagtggtcgacaacaaactntagcaacgtagtacgtttacgaggggcgacgggtctaccgagtacggaccgaacgggacaccggttcactcacgaccaacgtaaccggactaccgtagtcgggagccgacggagaccgaaggactacgaactacgttctacggaacgaccgaacggtaccttatttacgttancggttaggcgaggtacgtttacggttaccggtcggttcgtttcggtttttaccgg

SEQ ID NO: 349499 - DNA, 775 bp, Homo sapiens
  misc_feature: GZ8MTXP02FQWKD.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtaatgacccagtctccagactccctggctgtgtctctgggcgagagggccaccatcaactgcaagtccagccagagtgtttagacagcctaccaacaataagaactacttagcttggtaccagacaagaaaccaggtacacgcctacctaagctgcctactatttacgtgggacacgttacccgtaaccccggggaagtccccggggtacccctacggtacccgtacttacgacggtcggaccgacgggtccggggtcgtacgggggaactagtacgttttaccaccttccctaccaaccctacgttccgaaacggtccaaccggtccccgtggacccgtaagggtccttaaaggaaagtaaccggttgggttacgggtaccttaaaggtttttaccgttgggtacccgtttacggttacaacggtaacctttaaaatttaccttttaaaagttttactttaaccttttacccccgttaacccggtttaaaccggttttcccccggggacccccggttttaacgggggaaaacccctttaaaacggggttggttaaaactttaaccgtaaaaccgtaaaaacccggttacgtttcgggtacgggtacctacggttaacccc

SEQ ID NO: 349500 - DNA, 650 bp, Homo sapiens
  misc_feature: GZ8MTXP02G83IC.45.37.D04.1.454.CMB.2.raw
  modified_base (353)..(353): a, c, t, g, unknown or other
  misc_feature (353)..(353): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggagccgtggggcctcgagtgaggtctctgcagctctggctacaccttcaccggcgactatctccactgggtgcgacgacggcccctggacaggctgagtggatgggatggactcaacccctaacagtggtgacaacaaactntcgacagtagtagtttcgagggaccgagggtccaactagtacggacccgaagggggaccaccgtacctaacgtaccgacgaccgaacgcggaccctacgagtacgggaacgtccgtacggaacgacgaacggactaggaacctacgtaccgtacgggaaacccgtaccgtaacccggggtaacccttaaagtttttaccgttaacggtcgggtttacggaaccggggtaagtttaccgggtttacggttttacccggggtacggtttaaccgggtttccggggtttttttaacccgg

SEQ ID NO: 349501 - DNA, 642 bp, Homo sapiens
  misc_feature: GZ8MTXP02JE9ZR.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctgaggtgaggaagcgtggggctcagtgaaggtctctgcgaggtcttctggctacgaccttcgaccggcgactactctccacgttgggtgcgacgacggccccgtaggacgaagggtcgttggaggtggaagtggggatgggacttaccgaaaacccccgtaagaacgtcgggtacggacaaaccgaaactcgtacgactaacgaaggtaacgtttacggaggggtacgaacgggggttaccaaccgtaacgtacggaacccgtaaggggaccaccggtaccagtacgacgaccaacgacgtaccgtaacgagtacggagtaccgaggacgacaacggacttacgactacgtccgtagaccgtacgaaccgtctaaatttcgtacgtggagtaacggtaacgtacgttcgggttacgtcggttcgtttggtttttacccgg

SEQ ID NO: 349502 - DNA, 611 bp, Homo sapiens
  misc_feature: GZ8MTXP02FIDKE.45.37.D04.1.454.CMB.2.raw
  modified_base (361)..(361): a, c, t, g, unknown or other
  misc_feature (361)..(361): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacgcgccccgtggacaagggtcttgagtggagtgggatggactcaaaccccctacaagtggtgcaacaaactntgacacgagtaagttcgagggcgagggtcaccgatcgaccgaagggaccaccgtacactcacgaccaacgacgacccgtaacagtacgggaacgcgtacggagaccgaagtaaccgacggaacctagtcgtacgaaccggaaccgaccgggacccttaaaagttttacgtttaaccgtgtttaggaaccgggtaaaggttacgtttacgggtttaaccgggttcggtaccgtttcgggttttttacccgg

SEQ ID NO: 349503 - DNA, 582 bp, Homo sapiens
  misc_feature: GZ8MTXP02F6JT2.45.37.D04.1.454.CMB.2.raw
  modified_base (281)..(281): a, c, t, g, unknown or other
  misc_feature (281)..(281): n is a, c, g, or t
  modified_base (384)..(384): a, c, t, g, unknown or other
  misc_feature (384)..(384): n is a, c, g, or t
  modified_base (463)..(463): a, c, t, g, unknown or other
  misc_feature (463)..(463): n is a, c, g, or t
  modified_base (471)..(471): a, c, t, g, unknown or other
  misc_feature (471)..(471): n is a, c, g, or t
  modified_base (476)..(476): a, c, t, g, unknown or other
  misc_feature (476)..(476): n is a, c, g, or t
  modified_base (530)..(530): a, c, t, g, unknown or other
  misc_feature (530)..(530): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcagtgaaggtctcctgcagcttacgtggctacaccttcgaccgggcactatccnccacgtggtcgcgacacggccccctaggaccgaagggcttggagtggagtgggatggactacaaaccccctaagaagtgggtagacaaacaaactgcgacaanaaggtaacgtttcgaaggggtactacggggtacacccgagtacggaccgtagggaccacgtacatcagcacacgctacngtgagtcngaganacgactgactactcgagaccgacacggtaccttaaatttactacgtgttaccgnggtaaacggtgtttaccgggttagggtcggtttaccgttcggtttttacccg

SEQ ID NO: 349504 - DNA, 610 bp, Homo sapiens
  misc_feature: GZ8MTXP02F5KY7.45.37.D04.1.454.CMB.2.raw
  modified_base (287)..(287): a, c, t, g, unknown or other
  misc_feature (287)..(287): n is a, c, g, or t
  modified_base (462)..(462): a, c, t, g, unknown or other
  misc_feature (462)..(462): n is a, c, g, or t
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagcccactccccaggtgcagctggtgcagtctggggctgaggtgaggaagcctggggcctcagtgaaggtctcctgcaaggcttctggctacaccttcaccggcgactatctccactgggtncgacacggccccctggacaagggcttgagtggagtggggatgggactaccgaaaccctaaccgaagtggtaggacaacaaaactatgacaacagtaagtttcgagggacagggtaccacagtacgacgaggaccacgtaccatcagacacgaacgcctaacagtaggacgtacgnggaacgccgaagaccgttaggaacctaagttcgtacgaaccgaaccgtaccgggtaccttaaagttttaacttaccgttggtacgtacggtaaggtacgtttacggtttaccggggtggtccgtttacggtttccgtttttaacgggg

SEQ ID NO: 349505 - DNA, 616 bp, Homo sapiens
  misc_feature: GZ8MTXP02H3G41.45.37.D04.1.454.CMB.2.raw
  modified_base (251)..(251): a, c, t, g, unknown or other
  misc_feature (251)..(251): n is a, c, g, or t
  modified_base (258)..(258): a, c, t, g, unknown or other
  misc_feature (258)..(258): n is a, c, g, or t
  modified_base (360)..(360): a, c, t, g, unknown or other
  misc_feature (360)..(360): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctgggctggaggtgaggaagcctgggcctcagtgaaggtctcctgcaaggcttcnggctacnccttcaccggcgactactcctccacgtgggtgccgacgacggccccgtggaccgaagggcttggaggtgggagtgggagtggactacctaaacccccctaanaagtgggtacggacaaacgaaactgtgaccaacgtagtaagtttacgagggcgacgggtcacgatcgaccgtagggacctacgtccacgtccacggacaacgacgacctaaccgtagtaccgggagaccgtgacggaccagaacctgaactagtccgtacgaaccgaccgtacggacccttaaagtttacttacgtcgtagtaacggtaggtacgtttacgggttaccggtcggttacctttcgggtttttacccg

SEQ ID NO: 349506 - DNA, 699 bp, Homo sapiens
  misc_feature: GZ8MTXP02FNPFT.45.37.D04.1.454.CMB.2.raw
  modified_base (228)..(228): a, c, t, g, unknown or other
  misc_feature (228)..(228): n is a, c, g, or t
  modified_base (324)..(324): a, c, t, g, unknown or other
  misc_feature (324)..(324): n is a, c, g, or t
  modified_base (326)..(326): a, c, t, g, unknown or other
  misc_feature (326)..(326): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcccagngaggtacgtcctcgcgagtagtctggcgtactacctcctaccgacggactactctcctacgcggtggcgacgacgccgcgacgagacgtgtgaggngnggngngacgactacctaacaagtagtgacgacaaactatgcacaagtaagttacgtagggagtacggtacgaccagtacgacggaacggaacgaccgttaccgacacgtaaccgacgaaccaaccggaacctacccgtaaagtacgggacgggtaccgtacggtaagaacccgaagggaacccttaaacgggaccgtaacttaaacgttccgggaaaacccgaaaaccgggtacccgttaaaccggtttaacctttaaagtttttaacgtacgggtttacggaaccggtagggttaacggtttacggtttttaaccggggttccgggttaacggttttcccggtttttaacggttttccggtttaaaccgggg

SEQ ID NO: 349507 - DNA, 681 bp, Homo sapiens
  misc_feature: GZ8MTXP02JRQUL.45.37.D04.1.454.CMB.2.raw
  modified_base (256)..(256): a, c, t, g, unknown or other
  misc_feature (256)..(256): n is a, c, g, or t
tcagacgcgatcgacacgaccggtgctcgatttagtagcatactgttgggtttgggggagagcatcacccagcaaccacatctgtcctctagagaatccccctgagagctccgttcctcaccatggactggacctggaggatcctcttcttggtggcagcagccacaagagcccactcccaggtgcagctggtgcagtcgtggggctggaggtgaggaagccgtggggcctgagtgaagtctcctgcaggcttcgnggctacaccttcgaccggcgactatcctccacgtgggtcgcgtaccgacggcccccgtaggaacgaaggggtctttagggaggttggagtggggtatgggtactaccccgaaacccgtaaagacgtgggtacggacctaaacaacgtagtacggaccaagaagtaacggtttcgaagggacgtaggggtaccacgagtacgaaccgagggaccacggtacctagccgaacgaccaacgtacgaccctaacgagtagggactcgaggacgacgacggtactacggaactacgttaccgaggaaaccgacggtaaacccggtacctttaaactttttaacgtaccggtaggttaaccgggtacgggttaagggttacggttttaccggggtttaacccgggtcgggtttaccggttttttcccgggg

SEQ ID NO: 349508 - DNA, 668 bp, Homo sapiens
  misc_feature: GZ8MTXP02JEWRS.45.37.D04.1.454.CMB.2.raw
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgagggaagccgtggggcctcagtgaaggtctcctgcaaggcttctggctacaccttcaccggcgactatcctccactgggtgcgacgacggcccctggacaagggtcttgaggtggagtgggatggactcaaacccccctaanaagtggtaggaccaacaaactntcgacaacgtagtaacggtttcgagggcgtaaggggtaccaaccagtacgacccgaaggggaccaccggtccaagtcgacgacaacacggtcctaacgacgtgggacgaccgtaggacgacgaacggtacgacggaaacctacgtaccgtacgggaaccggaaccgtaaccggggtaccccttaaaaggtttttaccttaaccggttggttacggaaccgggtaaggggttaaacggtttccgggggttttaacccgggtcgggtttccggtttacggggtttttttaaccccgg

SEQ ID NO: 349509 - DNA, 573 bp, Homo sapiens
  misc_feature: GZ8MTXP02JPCPM.45.37.D04.1.454.CMB.2.raw
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacgaccttcaccggnactatctccatgggtncgacaggcccctggacaaggctgagtgatgggatggatcaaccctaaacagtggtagacaacaaactatcgacacgtaagtaacgttacgacggacgacggacgacagtacgacgacggaacgacgtacgactacacgacacacgaccgtacacgtagacgacgacgacgacgacgacgtacgtacgtactacgtacgaacgacgacgtacgtaactttaacgttacgtacgtagtacgtaaggtacgttacggttaccggtacggtacgtttacggtttacgtttacg

SEQ ID NO: 349510 - DNA, 556 bp, Homo sapiens
  misc_feature: GZ8MTXP02IATVT.45.37.D04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (352)..(352): a, c, t, g, unknown or other
  misc_feature (352)..(352): n is a, c, g, or t
  modified_base (422)..(422): a, c, t, g, unknown or other
  misc_feature (422)..(422): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagctgggctngtgaggtctctgcaggctcngctacacttcaccggcgactatctccacgtgggtcgcgacacggccccctggacaagggtcttggagtggatgggatggatcccaaccctagatggagacaactaactntgacacgagtaacgtttcgaggcgaggtcacgagtcgaccgaggacacgtacagtcagcacacgacctanagtaggacgacgtagacgtcgagacgtagactagtccgtagaccgacgtaccggtaccttagtttacgtttaacgtggtaacggtaccgtaaggttacgtttacgggtttaccggtcggtttaccgttttcggg

SEQ ID NO: 349511 - DNA, 593 bp, Homo sapiens
  misc_feature: GZ8MTXP02H81OU.45.37.D04.1.454.CMB.2.raw
  modified_base (193)..(193): a, c, t, g, unknown or other
  misc_feature (193)..(193): n is a, c, g, or t
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
  modified_base (315)..(315): a, c, t, g, unknown or other
  misc_feature (315)..(315): n is a, c, g, or t
  modified_base (347)..(347): a, c, t, g, unknown or other
  misc_feature (347)..(347): n is a, c, g, or t
  modified_base (557)..(557): a, c, t, g, unknown or other
  misc_feature (557)..(557): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtncagtcgtggggctggaggtgaggagccgtggggcctgagtgaaggtcnctgcaggcttngctacncctcacggnactntctcacgtggtncgacacggcccctaggacgaagggtcttaggngtggagtgggatggactacccaaacccgtaanagtgggtcgacaactaactcgagaccaacgtaagtaacggtttagacgggacgtaaggggtccaacgagtacggaacccgaacggggacctaacggtacccaacgtacgaacgaccaacgaaaccgtaccgttaacgagtacgggaacgtccgagacgacgtaagacgtacgactacgtactacggaccacgacgtactattacttacgngtgcgaaggtcgttacggttccggtgttcgtttcgg

SEQ ID NO: 349512 - DNA, 614 bp, Homo sapiens
  misc_feature: GZ8MTXP02JXN02.45.37.D04.1.454.CMB.2.raw
  modified_base (384)..(384): a, c, t, g, unknown or other
  misc_feature (384)..(384): n is a, c, g, or t
  modified_base (469)..(469): a, c, t, g, unknown or other
  misc_feature (469)..(469): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttctggctacaccttcgaccggcgactactctccacgtggtgcgacgacggcccctggaacgaacgggtcttggaggtggagtggggatgggactaccaaaccccctaacgaagtggggtacggctaacgaaactntcgacaacagtaagtttcgaggggcgagggtccacagtcgaaccgagggacacgtaccgatacgacgcaacgtacgccctaacgngtaggagtacgagacgacgacgtacgtacgaactacgtacgtacggaaccgaccgtaccgttacttacgtttaacgtacgtcggtacggtaacggtacggttacggtttacgggtttaccggtcggtttacggttttcggtttcg

SEQ ID NO: 349513 - DNA, 572 bp, Homo sapiens
  misc_feature: GZ8MTXP02GR1TF.45.37.D04.1.454.CMB.2.raw
  modified_base (356)..(356): a, c, t, g, unknown or other
  misc_feature (356)..(356): n is a, c, g, or t
  modified_base (375)..(375): a, c, t, g, unknown or other
  misc_feature (375)..(375): n is a, c, g, or t
  modified_base (423)..(423): a, c, t, g, unknown or other
  misc_feature (423)..(423): n is a, c, g, or t
  modified_base (474)..(474): a, c, t, g, unknown or other
  misc_feature (474)..(474): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtgggcctgagtgaggtctctgcaggcttcgtggctacaccttcgaccggcgactactcctccgacgtgggtcgcgaccgacggccccgtggaaccgaggcttggagtggagtgggatggataccgaaaccccgtaanagtcggagacaacaaactntacgacacgagtaacgttcgagggcgagggtcacagtcgacgaggacncgacacacacgacacacgacctagagtaggacgcgtagacgacgagtacgngaactgtacacggacgacgaccggtacttatttacgtacgttgacgtaacggtacggttacgttacggtttacggtcggttcgtttacggttttccgg

SEQ ID NO: 349514 - DNA, 645 bp, Homo sapiens
  misc_feature: GZ8MTXP02JY74J.45.37.D04.1.454.CMB.2.raw
  modified_base (201)..(201): a, c, t, g, unknown or other
  misc_feature (201)..(201): n is a, c, g, or t
  modified_base (467)..(467): a, c, t, g, unknown or other
  misc_feature (467)..(467): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagacgcccactcccaggtgcagctggtgcagtcgnggggctggaggtgaggaagccggtggggcctcgaggtgaacggtctaccgtgacgaaggtcttcgtggcctactaccgttccgaccggcgtactactcctcgacgtgggtcgcgacgacggcccgtaggacgaggtcttggagtggagtggagcggtactacccgaaacctagacgtggtacgacaactatacgacgacctaacgagtacggtttacgacgggacgtacgggtaccacgacgtacgaacgacggacctacgacacncgacgacacgactactacgagtagggacgacgacggacgaccgaaggtactaacgtacaacgtcgtaaaccgaaaccggaaccgtaccggttaactttaacgtttacgttacggtaggtaaccgagggtaacggttacgtttccggttacggggtttacggttacggtttttaccggg

SEQ ID NO: 349515 - DNA, 691 bp, Homo sapiens
  misc_feature: GZ8MTXP02IG2WO.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaagccgtggggcctcgagtgaacggtctccgtgacgaaggtcttcgtggacctaccgacccttcgacccggcgacctactcctccgacgtcggggtgccgacgacggccccgtaggaacgaaggtcttaggagtggagtgggatggaactaccgaaaccccctaagtagtgggtacggacaactaaactgtacgacaaacgaagttaagtttcggaggggtacgacggggtacaaccgagtacggaaccgagggaccacggtaccacgtacacgcaacgaccgtacctaacgagtcgggactccgtaggacgaccgagtaaccgtcggaaactacgtaccggtaacggaaacccgaccggtaacccggttaccttaaacgttttaacgttaaccgtgggttaacgaaccgggtaaggtttaacgtttaccggggtttaaccggtcggtttacggtttaccgggttttttacccggg

SEQ ID NO: 349516 - DNA, 566 bp, Homo sapiens
  misc_feature: GZ8MTXP02IXPR9.45.37.D04.1.454.CMB.2.raw
  modified_base (293)..(293): a, c, t, g, unknown or other
  misc_feature (293)..(293): n is a, c, g, or t
tcagacgcgatcgacacgaccggtgctcgatttagtagcatactgttggggtttgggggcatcaccccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacncggcccctggacaaggggcttgagtggagtggggatgggatacaaaccctaacaagtggtggcaacaaactatgcacagagtttcgagggacgagggtcaccgatacgaccgagggacacgtccatcagcactacgccctacagtaggagcgtagacgaccgagactcggaacatcgacgaacgacgacggtaccctaagtttacttacgtcgtacgacggtaaggtacgttacggtttaccggtggtcgtttacggttttccgttttacggg

SEQ ID NO: 349517 - DNA, 653 bp, Homo sapiens
  misc_feature: GZ8MTXP02JZJSE.45.37.D04.1.454.CMB.2.raw
  modified_base (356)..(356): a, c, t, g, unknown or other
  misc_feature (356)..(356): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagacgcccactcccgaggtgcagctggtgcagtcgtgggctgaggtgaggagcgtgggctgagtgaggtctctgcaggctcgtggctacaccgttcaccggcgactactcctccacgtgggtcgcgacgaccggccccgtaggacgaagggtcttaggaggtggagtgggatggataccaaaccccgtaanaagtcgggtacgacaacgtaaactgtacgactaaacgagtaaacgtttcggaagggtacggaacggggttaccaaccgaagtcggaaacccgaggggtaccaccggtaccacgtacgacgaccacgtacgacccttaacgagtgggacgaccgtaggacgacggaacgtacgtaccggaacgtacgtccgtacggaaccgtaccggacggtaccttaactttacgttaccgtggtacggcggtaaagttacggtttacggtttacccggtgggtttaccgtttcggttttaacccgg

SEQ ID NO: 349518 - DNA, 627 bp, Homo sapiens
  misc_feature: GZ8MTXP02FSO8H.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaaggtctcctgcaggcttctggctacacctcgaccggcgactactcctccacgtgggtgcgacgacggcccctggacgaagggtcttggagtggagtgggatggactaccgaaacccctaacgaagtggtacggacaaacaaactgtcgacaagaagtaagtttacgaggggtcacgggtcaccgatcgaaccgagggacacgtcacgtcacgcaacgacgacctaacgagtacgggacgaccgtagaacgtacgaacggtactacggaactacgtaccgtacggaacccgtaacgaaccgggtaccttaaacgttttacgttacgtcggtacggtaaccggtaaggtacgtttacgggtttaccggtacggtcggttttacggtttttacccgg

SEQ ID NO: 349519 - DNA, 707 bp, Homo sapiens
  misc_feature: GZ8MTXP02FTRXS.45.37.D04.1.454.CMB.2.raw
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (274)..(274): a, c, t, g, unknown or other
  misc_feature (274)..(274): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtgggcctnagtgagtctctgcagctngctacnctcaccgcactatctcacgtggtncgacgcggcccctggacgaaggtcttggagtggagtgggataggataccgaacccctaacaagtgggtacgacaacgtaaacttgacgacaaacgtaacgttaacggtttacggaacgggggtaccgtaacggggttaccaacccgtagacggaacccggaggggaacccgtaccgtaccgtacgaccgaacggaccaaaccgacgtaacccgtaacgaggttacggggaacgtcgtaacgggacgtacggaacggtaactacgaaccgtacgttaccgtaacggaacccggaaaccgtaacccgggttaaaccctttaaagttttaaccgtttaacccggtgggtttaacggaaccgggtaaagggtttacggtttaccgggggttttaaccggtacggggtttacccggttttcggtttttttaacccggg

SEQ ID NO: 349520 - DNA, 662 bp, Homo sapiens
  misc_feature: GZ8MTXP02HOMYY.45.37.D04.1.454.CMB.2.raw
  modified_base (218)..(218): a, c, t, g, unknown or other
  misc_feature (218)..(218): n is a, c, g, or t
  modified_base (495)..(495): a, c, t, g, unknown or other
  misc_feature (495)..(495): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtctggggctgaggtgaggagccgnggggcctcagtgaaggtctccgtgcgaaggcttcgtggctacaccttcgaccggcgtactatcctccacgtgggtgcgacgacggccccgtggaaccgaagggcttggaggtagggagttggggataggactaaccgaaaccccccgtaaagaaacgttgggtacgggacaaaccgtaaaactacgtgaacaacgtaagttaaacgtttcggagggtacgacgggtcaacccgatacggacgagggactacggtaccatcagactacgaccgactanaacgtggacgatacgagaccgagacgtacgaaccagttacgtaacggaaccggtaccgtaaacccgggtacttaaacgttttacgtacgttaaccgtcggtaacggtaacgggtacgtttaccgggtttacccgggtcggttccggttttaaccgggtttttcccgg

SEQ ID NO: 349521 - DNA, 604 bp, Homo sapiens
  misc_feature: GZ8MTXP02JFJH2.45.37.D04.1.454.CMB.2.raw
  modified_base (360)..(360): a, c, t, g, unknown or other
  misc_feature (360)..(360): n is a, c, g, or t
  modified_base (478)..(478): a, c, t, g, unknown or other
  misc_feature (478)..(478): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaggtctcctgcaggcttctggctacaccttcaccggcgactatctccactgggtgcgacacggcccctggacaagggcttggagtggatgggatggatcaacccctaacaagtggtaggcaacaaactntgacaacgagtaagtttcgagggtcgaagggtcacctagtacgaccgaggggacaccggtaccatacagaccacgacgacctaacagtacgggaagcgtaggacgacgacgtaaccgngaactcgtacgttacggaaccgaccgaacccgggtacccttaattttaacgtttaaccgtggttaggaaccggtaggtacgtttaccgggtttacgggtcggttccggtttcggttttttacccgg

SEQ ID NO: 349522 - DNA, 680 bp, Homo sapiens
  misc_feature: GZ8MTXP02I389B.45.37.D04.1.454.CMB.2.raw
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (365)..(365): a, c, t, g, unknown or other
  misc_feature (365)..(365): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaggtctcctgcaggcttcnggctacnccttcaccggcgactatcctccactcgggtgcgacaggcccctggacaagggcttggagtggagtggagtggatccaaccccctaacaagtggtggacaacgaaactntacgcaacgtacgtaagtttcgaggggcgacgggtaccaccgtagtacgacccgtaaggggaccaccggtaccctaacgtccgaagccaaaccgacggtaccctaacccgtagttagggacggtaccgtcgggaacgacgaacggtaaccgttacggaaccgtaacgtccggttaacggaccccggttaaaccgaccggggtaccccttaaagtttttacgttaaacccgttggttacgaaccgggtaagggttaaacggtttcggggttttaacccgggttacggttaccggttttcgggttttttaaccccgg

SEQ ID NO: 349523 - DNA, 623 bp, Homo sapiens
  misc_feature: GZ8MTXP02JE3Q2.45.37.D04.1.454.CMB.2.raw
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (351)..(351): a, c, t, g, unknown or other
  misc_feature (351)..(351): n is a, c, g, or t
  modified_base (426)..(426): a, c, t, g, unknown or other
  misc_feature (426)..(426): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtggggcctcgagtgaggtctctgcaggcttcnggctacncctcgaccggcgactatcctccacgtgggtgcgacgacggcccctaggacgaagggtctaggagtggagtgggatggactaccaaacccctaanagtcggtacgacaaacaacgtgtgacacgtaagtacgtttcgaagggcgtacgggtcacgtagacgacgaggacncgtacagtcagcacgacgtacctaacgtagtacgggacgacgacggacgacgaacgacgtacgaacgtacgttaccgacgtaaccggacgtaaccccggtactttaacgttttaacgtaccgtagttaccggaacggtaagggttacgtttacggggtttacccggttcggtttaccggttttcggtttttacccgg

SEQ ID NO: 349524 - DNA, 646 bp, Homo sapiens
  misc_feature: GZ8MTXP02IHBD7.45.37.D04.1.454.CMB.2.raw
  modified_base (228)..(228): a, c, t, g, unknown or other
  misc_feature (228)..(228): n is a, c, g, or t
  modified_base (254)..(254): a, c, t, g, unknown or other
  misc_feature (254)..(254): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctnagtgaaggtctcctgcaaggcttcgnggctacaccttcgaccggcgactatcctaccacgtgggtgccgacgacggcccctaggacgagggtcttggaggtggagtgggatggactaccaacccctaagagtggtacgacaacaaactgtgacacgaagtagttcgagggacgagggtcaacgagtcgaaccgacggggacaccgtcacgtacacgactaacgacgtaccctaacgtagtacgggacgtccgtaggacgacgaacgtaccgtacggaacctacgttaccgtaacgggaccgtaaacccggaccggtaaaccctttaagttttacgttaaccgttggtacggtaacggtaacggttagtttaccggggtttaaccggggttcggtttccggtttcggttttttacccgg

SEQ ID NO: 349525 - DNA, 636 bp, Homo sapiens
  misc_feature: GZ8MTXP02JHMIL.45.37.D04.1.454.CMB.2.raw
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (276)..(276): a, c, t, g, unknown or other
  misc_feature (276)..(276): n is a, c, g, or t
  modified_base (279)..(279): a, c, t, g, unknown or other
  misc_feature (279)..(279): n is a, c, g, or t
  modified_base (304)..(304): a, c, t, g, unknown or other
  misc_feature (304)..(304): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctgggtgcgagtcgtggggctggaggtgaggagccgtggggcctgagtgaaggtctcctgcaggcttnggctacncctcaccggcaactntcnccacgtggtgcgacgacgtccccgnggaacgagggtctgagtggagtgggatggactcgaaacccctaacgaagtggcgtacaaactaaacttgacgcctaaataccggtaagtttacgaggggcgacgggtaccaacacaggacccaggggacctacggtacaaccggtaacacgtacgaacacgtacctaacgtacgaggtacgtacgtaacggacgaacgtacgacgtacgtaacgtacgtacgacgaaccggaaccgtaacgttaactttaacgtttacgttaacgttggtacggtaacggtaaggttacggtttacgggttacggttcggtttacggtttaccgttttacgg

SEQ ID NO: 349526 - DNA, 624 bp, Homo sapiens
  misc_feature: GZ8MTXP02H0LSX.45.37.D04.1.454.CMB.2.raw
  modified_base (228)..(228): a, c, t, g, unknown or other
  misc_feature (228)..(228): n is a, c, g, or t
  modified_base (286)..(286): a, c, t, g, unknown or other
  misc_feature (286)..(286): n is a, c, g, or t
  modified_base (291)..(291): a, c, t, g, unknown or other
  misc_feature (291)..(291): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactcccaggtgcagctggtgcagtcgtggggctgaggtgaggaagcctggggcctnagtgaagtctcctgcaggctctggctacaccttcaccggcgactatctccagtgggtncgacncggccctggacaagggcttgagtggagtgggatggatacaaacccctaacgaagtggtaggacaacgaaaactgtacgacaacgtaagtaaacgtttcgaacggggtcgaacggggtccaaaccgagtacggaacccgaagggggaacctaccggtaccaagtaccgacgaccacgaccaccgttaacaggtaggacgtacgtagaacgagtaacggtacacggacacgttcacggaccggaacgaccggtacgttaactttaacgtaccgttggtacgccggtaaggtacgttacgggtttaccggtcggttccgttttacggttttcccgg

SEQ ID NO: 349527 - DNA, 707 bp, Homo sapiens
  misc_feature: GZ8MTXP02JWU1H.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcgagtgaaggtctcctgcaggcttctggctacaccttcgaccggcgactactcctccacgtgggtgcgacgacggccccgtggacgaagggtcttaggagttggagtggggattagggactaccaaaccccccgtaaacgaagttcggggtacggacaacgtaaaacgtgttacggaacaacgtaaacgtaagttttacccggaagggggtaccgaaacgggggttacccaaaacccgtacgttaccgggaaacccggaaacgggggaacccgaacccgggtttaaccaacgttaccgaacgtaccgaaaccgaccggtacccctaagtaaccggttagggaaccgtcgtacgaacggactaacggacgtacggactacgtaccgtagaaacccgacgtaccggtacctaagttttactacgtcgttaggcgtaaggtacgttcggtttaaccggttcggtacgtttacggtttttccgg

SEQ ID NO: 349528 - DNA, 639 bp, Homo sapiens
  misc_feature: GZ8MTXP02JP9A4.45.37.D04.1.454.CMB.2.raw
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
  modified_base (295)..(295): a, c, t, g, unknown or other
  misc_feature (295)..(295): n is a, c, g, or t
  modified_base (464)..(464): a, c, t, g, unknown or other
  misc_feature (464)..(464): n is a, c, g, or t
  modified_base (502)..(502): a, c, t, g, unknown or other
  misc_feature (502)..(502): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctgaggtgaggagcgtgggcctgagtgaaggtctctgacaggtcttcgnggctaccnccttcgaccggcgactatcctccgacgtgggtcncgacgcggccccgtaggacgaagggtctttaggaggtggtagtaggggtataggactaccccgaaaccgtaacgaagtcgggtagaaccaactaacgtatacgacgaacgtagtaacgttcgagggacgacggtaccacgagtacgaaccgaggaccacgtaccgaacncgacgaccacgacgtacgtacgaggtacggacgtacgngaacgtacgacgtaacgacgtaacgtacgtaccggtacgaccgtaccggtacgttaacttaacgtttacgtacgtcggtaacggtaccggttaaggttacggtttacgggtttaccgggttcggttacggttttcgg

SEQ ID NO: 349529 - DNA, 723 bp, Homo sapiens
  misc_feature: GZ8MTXP02ICCT5.45.37.D04.1.454.CMB.2.raw
  modified_base (249)..(249): a, c, t, g, unknown or other
  misc_feature (249)..(249): n is a, c, g, or t
  modified_base (273)..(273): a, c, t, g, unknown or other
  misc_feature (273)..(273): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagacgcccactcccgaggtgcagctggtgcagtcgtgggctggaggtgaggagccgtgggcctgagtgaagtctcgtgcagtcttgngctacactcgaccgcgactactcnccacgtgggtcgcgacgaccggccccgtaggacgaaggtcttggaggttggagtgggagtacggaactacccaaaaccgtaacgtaaggtcgggtacgacctaaacgtaaaaccgttgtccggaactaaacggtaaaggtttaaacggtttaccggaacgggggtaccgttaaccgggggtaaccctaaaccggaaacggtaccggaaacccgggaacgggtaaccccgtaaccggttaccctaacgtaaccgaaccggtaccaaaccgaccggtaacccttaacgaggtacggacgtacgacgaacgacgaacggactacgacacgtacgaacgaccggaacgacccggttaacttaaatttacttacggtacggtacggacggtaacggttacgtttacggggtttaccggtcggtttaccgtttacgggtttttaccgtttacgggg

SEQ ID NO: 349530 - DNA, 572 bp, Homo sapiens
  misc_feature: GZ8MTXP02IUHQG.45.37.D04.1.454.CMB.2.raw
  modified_base (248)..(248): a, c, t, g, unknown or other
  misc_feature (248)..(248): n is a, c, g, or t
  modified_base (286)..(286): a, c, t, g, unknown or other
  misc_feature (286)..(286): n is a, c, g, or t
  modified_base (348)..(348): a, c, t, g, unknown or other
  misc_feature (348)..(348): n is a, c, g, or t
  modified_base (400)..(400): a, c, t, g, unknown or other
  misc_feature (400)..(400): n is a, c, g, or t
  modified_base (465)..(465): a, c, t, g, unknown or other
  misc_feature (465)..(465): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggctcagtgaaggtctctgcaaggcttcnggctacaccttcaccggcgactatcctccacgtgggtncgacacggccccctggaaccgaagggtcttggagtggatggggatggatccaaccccctaanagtggtgacaacaaactgtgacacgagtacgttcgagggcagggtcaaccgntcgacgaggacaccgcagtacagcacgacgacctagagtggagcgtagagaccagacgtagaacnctacgtacgacgaccacggtaccttaattttacgtaacgtcggttacgaaccgtaagggtacgtttacgggtttaccggtacggttccgtttcggttttttacccgg

SEQ ID NO: 349531 - DNA, 555 bp, Homo sapiens
  misc_feature: GZ8MTXP02HDHQI.45.37.D04.1.454.CMB.2.raw
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (339)..(339): a, c, t, g, unknown or other
  misc_feature (339)..(339): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctcagtgaggtctcctgcagctngctacnctcacggcactatctcagtggtgcgacgacggcccctaggacgaggtcttggaggtggagtgggataggactacaaccccctaanaagtggtgacaacaaactgtgactacgagtaagttcgagggacgaggtcacagtacgacgagggacacgtcagtacagacacgacgtacctaacgagtaggacgctagacgacgaacgactagactagtcgacgaacgacgaccggtacctagtttacgtacgtggtacgtggtaacggttagttcggttacggtcgttcgtttcggttttaccgg

SEQ ID NO: 349532 - DNA, 625 bp, Homo sapiens
  misc_feature: GZ8MTXP02JDV5Q.45.37.D04.1.454.CMB.2.raw
  modified_base (250)..(250): a, c, t, g, unknown or other
  misc_feature (250)..(250): n is a, c, g, or t
  modified_base (375)..(375): a, c, t, g, unknown or other
  misc_feature (375)..(375): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcagtgaaggtctcctgcaggcttcnggctacaccttcaccggcgactatcctccacgtgggtgcgacgacggcccccgtaggaccgaaggggcttggaggtgggagtgggatggataccaacccctaacagtggtacggacaacaaactntgacacagtaagtttcgagggcgagggtcaccagtacgaccgagggacaccgtacagtacacgacacgacgtacctaacgtagtacgggacgtcgtacggacgacgaacgtaacgttacggaactacgttccgtaacggaaacccggaaccgacccgggtacccttaaattttaccgttaaccgtggtacggtaacggtaaggtacgtttacgggtttaaccgggtggttacgtttcggtttttacccgg

SEQ ID NO: 349533 - DNA, 653 bp, Homo sapiens
  misc_feature: GZ8MTXP02HV9BS.45.37.D04.1.454.CMB.2.raw
  modified_base (365)..(365): a, c, t, g, unknown or other
  misc_feature (365)..(365): n is a, c, g, or t
  modified_base (384)..(384): a, c, t, g, unknown or other
  misc_feature (384)..(384): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcgaaggcttcgtggctaccaccttcaccggcgactatcctccacgtgggtgccgacgacggcccccgtaggaccgaaggggtcttaggagtggagtggggatggactaccgaaccccctaanagtggtagacaacaaactntgacaactagtaagtttcgaagggcgacgggtacaacccgagtacggaaccgagggaaccaccgtaccaagtcgaacgacaaccgacgaccgtaacgagtaggacgaccgtaggaacgacgtaacgtaccgtaagaccgtaactacggtacggaaccgtaaacccgaaccgggtaccttaaacttttacgtaaccgttggtacgtaaccgggtaaggttacggtttacgggtttacccgggtaggttccgttttacggtttttacccgg

SEQ ID NO: 349534 - DNA, 616 bp, Homo sapiens
  misc_feature: GZ8MTXP02JFXCP.45.37.D04.1.454.CMB.2.raw
  modified_base (228)..(228): a, c, t, g, unknown or other
  misc_feature (228)..(228): n is a, c, g, or t
  modified_base (258)..(258): a, c, t, g, unknown or other
  misc_feature (258)..(258): n is a, c, g, or t
  modified_base (361)..(361): a, c, t, g, unknown or other
  misc_feature (361)..(361): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcgtggggcctnagtgaggtctcctgcaaggctctggctacnccttcaccggcactactcctccacgtgggtgcgacacggcccctggacagggcttgagtggatgggatggatacccaaccctaacagtggtggacaacaactntacgacacgagtaagtttcgagggtacgagggtccacgtagtacgaaccgagggaccacgtccatacgagaccacagaccctaagacgtagggacgcgtaggacgcgacgtacgtacgaactacgttacgtacggaccgaaccgaaccggtacccgttaattttaaacgttaccgttaggttaacggaaccgggtaagggttacggtttaccgggttttaacccgggttacgggttaccggttttttacccgggg

SEQ ID NO: 349535 - DNA, 603 bp, Homo sapiens
  misc_feature: GZ8MTXP02GOY6J.45.37.D04.1.454.CMB.2.raw
  modified_base (257)..(257): a, c, t, g, unknown or other
  misc_feature (257)..(257): n is a, c, g, or t
  modified_base (347)..(347): a, c, t, g, unknown or other
  misc_feature (347)..(347): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggaagccgtggggcctcagtgaggtctctgcaggcttctggctacnccttcgaccggcgactactctccacgtgggtgcgacacggccccgtggacgagggcttggaggtggagtgggatggactcaacccctaanagtggtacggacaacaaacgtgtgacaacgtagtaacgtttcgagggcgtaacggggtcaaccgagtacggaaccgaaggggtaccacggtccaagtacacgacaacacgacctacgagtcggaacgctagacgacacgactgacacgtcgtacgaacgaccgtaccgtaccttaagtttacgttacgtaggtacggaaccgtaaggttacgtttacggggtttacggtcggttaccggtttcggtttttacccgg

SEQ ID NO: 349536 - DNA, 665 bp, Homo sapiens
  misc_feature: GZ8MTXP02JQE1F.45.37.D04.1.454.CMB.2.raw
  modified_base (248)..(248): a, c, t, g, unknown or other
  misc_feature (248)..(248): n is a, c, g, or t
  modified_base (374)..(374): a, c, t, g, unknown or other
  misc_feature (374)..(374): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggagccgtgggctcgagtgaggtctctgcaggcttcgnggctacaccttcgaccggcgactactcctccacgtcgggtgcgacgaccggtccccgtaggaacgaaggtcttggacggtggagtgggatggactcaaacccccgtagagtgggtagacaacaatntcgacacgagtaagttcgaggacgagggccacgtagtacgaccgaacgggtacaccgtacaacgtcgacgacaaccgacggtacccctaagtacggtggacgtaccgtagggacgaccaacggtaactcgaaacgtacgttaaccggtacggtaaacccggaaccggtaacccggttaccttaaacgtttttacgttaacggttacggtacgggtaaccggggtaacggttaacggttttacccgggggtttacggttacggtttaccggtttccggttttttaacccggg

SEQ ID NO: 349537 - DNA, 644 bp, Homo sapiens
  misc_feature: GZ8MTXP02JAXUU.45.37.D04.1.454.CMB.2.raw
  modified_base (351)..(351): a, c, t, g, unknown or other
  misc_feature (351)..(351): n is a, c, g, or t
  modified_base (372)..(372): a, c, t, g, unknown or other
  misc_feature (372)..(372): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctctgcaggcttcgtggctacaccttcgaccggcgactatcctccacgtgggtgcgacacggcccctggaccgaagggcttggagtggagtgggatggactaccaaacccctaanagtggtacggacaacaaactntgacaacgaagtaagtttcgaggggcaacggggtaccaaccgtagtacggaaccgaaggggaaccaccgtaccaagtaccgagaccaacgacgacctaacgagtcgggaacgctagacgacaacggaactacggaactacgttaccgtacggaaaccgaaccgaccgggtaacccttaaagttttaacgttaaccgttggtacgtaaccggtaagggttaacgtttacggggtttaccgggttcggttaccggtttacggttttttacccgg

SEQ ID NO: 349538 - DNA, 753 bp, Homo sapiens
  misc_feature: GZ8MTXP02HH7T6.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcgaaggcttcgtggctacaccttcgaccggcgactactccccagtgggtcgcgacacggccccctaggaccgaagggtcttggaggtgggatggggatggactcaaaccctaaccgaaagtgggtacggacaaacgtaaaacctagtcgacctaaacgaagggtaaacgtttaccggaagggggaccgtaaacgggggtacccaaccgtaacgttacggaaacccggaacgggggaaaccctaacccggttacccaaacgttaccgaaaccgggtaccgtaaaacccacgggtacccccttaaagaccggtttagggggaaaccgtaccggtaaggaaccgaaccgtaaacggtaccgttacggaacctaacggtacgtaacccggtaaaccggaaccggtaaccggttaaccttaacgtttaaacgttacgtacggtacggtacggtaaggttacggtttacggtttaccgggttcggttaccggtttacggttttaccggtttacgg

SEQ ID NO: 349539 - DNA, 666 bp, Homo sapiens
  misc_feature: GZ8MTXP02JV2G2.45.37.D04.1.454.CMB.2.raw
  modified_base (228)..(228): a, c, t, g, unknown or other
  misc_feature (228)..(228): n is a, c, g, or t
  modified_base (249)..(249): a, c, t, g, unknown or other
  misc_feature (249)..(249): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgccagctggtgcagtcgtggggctggaggtgaggagcctggggcctnagtgagtctctgcaagtcttnggctacaccttcgaccggcgtactatcctccgacgtgggtcgaccgacacggcccctggaacgtaaggggcttaggacggtggagtggggaatggactaccaaaccccctagagtgggtacgacaactaactgtcgacacgtagtagttcgagggtacgacggggtacaaccgtacgtacggaaccgtacgggggaaccaccgggttaccaaacgtccgacggacaaccggttaccgtaccctaaccgtacgtaggggaccttacgtaggacgttacccgaaggttacctaggaacccgttaaacgtcgtacggaccgaaccgtaccggtacttaacgtttaacgttacgttacggtacggtaacggtacggttacggttacggttacgggttacggttacggtttacggtttaccg

SEQ ID NO: 349540 - DNA, 553 bp, Homo sapiens
  misc_feature: GZ8MTXP02FLFKE.45.37.D04.1.454.CMB.2.raw
  modified_base (344)..(344): a, c, t, g, unknown or other
  misc_feature (344)..(344): n is a, c, g, or t
  modified_base (363)..(363): a, c, t, g, unknown or other
  misc_feature (363)..(363): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctcctgcaaggcttctggctacaccttcaccggcgactatctccactgggtgcgacaggcccctggacaagggcttgagtggagtgggatggatcaaaccccctaanaatggtggacaacaaactntgcaacagtaagtttcgagggtacaggggtcaccagtagaccgagggacacgtccatcagcaacacgacctacgagtaggagctagacgcaagacctagaacctagtactacggacgaccacggacctaatttacttacgtgtgaacgtaggtagttacggtttacggtcggtcgttacggtttttcccg

SEQ ID NO: 349541 - DNA, 568 bp, Homo sapiens
  misc_feature: GZ8MTXP02JKWDT.45.37.D04.1.454.CMB.2.raw
  modified_base (346)..(346): a, c, t, g, unknown or other
  misc_feature (346)..(346): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctcctgcaaggcttctggctacaccttcaccggcgactatcctccacgtgggtgcgacgacggcccctggacagggcttggagtggatgggatggatacaaccccctanaagtggtacggacaacgaaactgtcgacaacgagtaacgtttcgagggtcgagggtcaccgatcggacaggacacgtcatcagcacacgacctacagtggacgcgtaggacgacgaacgactaggaactactcgtacgaaccgacgaccggtacctaatttacgttacgtgtagaacggtaggtacgtttacggttacggtcggttcgttcggtttttaccg

SEQ ID NO: 349542 - DNA, 615 bp, Homo sapiens
  misc_feature: GZ8MTXP02JG0E7.45.37.D04.1.454.CMB.2.raw
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
  modified_base (375)..(375): a, c, t, g, unknown or other
  misc_feature (375)..(375): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctnagtgaaggtctcctgcaaggcttcgnggctacaccttcgaccggcgactatcctccacgtgggtcgcgacacggcccctggaccaagggcttgacgtggatggggatggactacccaaaccctagaactgggtacgacaacaactntagccgtaacagtaagtttacgacggggtcagggtaccaccgtaagcggaaccggaaggaccacggtaccagacgaacgaccgacgaacggacctacgaggtaggacgtaccgtaggagaccgtaggaccttacgaaactcgttacgtacggaaccgaccggtaacggtacccttaagtttaacctcgacgttggaaccgtaggttacgttacggtttaccggtggttcgttttaaccgg

SEQ ID NO: 349543 - DNA, 746 bp, Homo sapiens
  misc_feature: GZ8MTXP02GHPZA.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggaagccgtggggcctcgagtgaaggtctcgtgcaggcttcgtggctactaccttccgaccgggcgactactcctaccacgtgggtgccgaccgacggtcccccgtaggaaccgaaggggtctttacggagggttagggagttggggaatgggaactaccaaaccccccgtaaagtaagtcgggtacggaaccaaacgtaaaacttgtcgaacgaacgtaacgtaaggtttacgaaggggtaccgtaacggggtacccaaaccggtacgacggaaccggaacggggaaccaacccgggttacccaagtaccgaaacggccaaaccgaccgtaacccgtaaccgtaaggttacgggaaacgtccggtaaggaaacggccgaaacggtaacgttacgaaccgtacgttaccgtacggaaacccgaacggaaacccggtaacctttaaagtttttaacgtacgttcggttaaggaaccggtaaggttacgtttaccgggtttaaccgggttggtaccggttttcggtttttaacccgg

SEQ ID NO: 349544 - DNA, 580 bp, Homo sapiens
  misc_feature: GZ8MTXP02GI47Q.45.37.D04.1.454.CMB.2.raw
  modified_base (246)..(246): a, c, t, g, unknown or other
  misc_feature (246)..(246): n is a, c, g, or t
  modified_base (555)..(555): a, c, t, g, unknown or other
  misc_feature (555)..(555): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtgggcctgagtgagtctctgcagtcttcnggctacgaccttcgaaccggcgtactactcctaccgacgtgggtcgcgacacggccctaggacgaaggcttaggagtacgggagtggataggactaccaacctaagagtggcggtacaactaaaccgttagcgtacacgaagtaagtttcgagggtcacgggtacacagtacgacgacgggacaccgtcagacgagacacacggcctaacagtaggacgtcgagacgcgaagtacgagtacatacgacgacgacgtaccggccttaagtttaccttagtcgtagagtaaggttacgtacggtttaccgnggtttcgttcggtttactttaacgg

SEQ ID NO: 349545 - DNA, 586 bp, Homo sapiens
  misc_feature: GZ8MTXP02FN5RI.45.37.D04.1.454.CMB.2.raw
  modified_base (252)..(252): a, c, t, g, unknown or other
  misc_feature (252)..(252): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctcctgcaggcttcnggctacacctcaccggcgactatctccacgtgggtcgcgacgacggccccgtggacgaagggtcgttgagtggagtgggatggactacaacccctaacaagtggtacggacaacaaactgtcgacaacgagtaacgtttcgaggggactaggggtcaccgagtacgaaccgagggaccaccgtaccactcagcacacgacctacagtaggacgctaggacgacgacgactacgaacacgttcgacgaccgaaccgaccggtaccttaagttttacgtacgtagtcggaacggtaggtacgtttcggtttaccggtggtcgtttcgttttaccgg

SEQ ID NO: 349546 - DNA, 650 bp, Homo sapiens
  misc_feature: GZ8MTXP02II7JM.45.37.D04.1.454.CMB.2.raw
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagcgtgggcctcagtgaggtctctgcaggcttcnggctacncctcaccggcactatcctcacgtgggtgcgacgcggcccctaggacgaagggtcttaggaggtgggtaggtagggagtcggactaccgaaaccctaaacgaagttggtacggacaactaaacctagtcgacaacgaagtaacgtttcgagggtactacggggtacacgagtacggaccgaagggaccctacgtaccagtccaacgaccaaccgtaacgaccccgtagaaggttcggacgtcgacgacgacgaacgacgtacggaacagtacgtacggaaccgaaccgaccggtaccttaagttttaacgttacgttccggtacggtacggaagggttacgtttaccgggtttacccgggttggttaccgttttcgggtttttaccgttttaaccgggg

SEQ ID NO: 349547 - DNA, 597 bp, Homo sapiens
  misc_feature: GZ8MTXP02J07GH.45.37.D04.1.454.CMB.2.raw
  modified_base (252)..(252): a, c, t, g, unknown or other
  misc_feature (252)..(252): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttcnggctacaccttcaccggcgactatcctccgacgtgggtgcgacacggccccctaggacgaagggcttgagtggagtgggatggataccaacccctaaacaagtgggtacggacaactaaactagtgacaacagtaatttacgaggggtacgagggtaccaaccgatacgaaccgagggacaccgtccaatcagcaaccagacctaacgagtagggagcgtagacgcaaggacctaggaacctataccgtaggaacccgagacccggtaccttatttaacgttaccgtcgttagccggtaggtacgtttacgggtttaccggtggtccgtttcgggtttttacccg

SEQ ID NO: 349548 - DNA, 605 bp, Homo sapiens
  misc_feature: GZ8MTXP02I2SDG.45.37.D04.1.454.CMB.2.raw
  modified_base (236)..(236): a, c, t, g, unknown or other
  misc_feature (236)..(236): n is a, c, g, or t
  modified_base (249)..(249): a, c, t, g, unknown or other
  misc_feature (249)..(249): n is a, c, g, or t
  modified_base (289)..(289): a, c, t, g, unknown or other
  misc_feature (289)..(289): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtgggctcagtgaggtctcngacaggtcttcgnggctacaccttcgaccggcgactatcctaccgactgggtncgacgtacggcccctggaacagggcttggagtggacgtgggatggactccaaaccccgtaacaagtgggtacgacaaacgtaaatgtacgacaacgtaagtaagtttacgaggggtacaaggggtaccacgtaacgacgaaccgaggaacgaccggtaccgaatacacgacgacgacgaccctagagtaggaccgagacgagacgaagtactacgactacgtcgtacgaaccggactacccggacttactttagaaccgttgaggtaaccgtaaaggtgtttacggttaccggtgtacggttttcgtttaacccgg

SEQ ID NO: 349549 - DNA, 669 bp, Homo sapiens
  misc_feature: GZ8MTXP02GY1MK.45.37.D04.1.454.CMB.2.raw
  modified_base (251)..(251): a, c, t, g, unknown or other
  misc_feature (251)..(251): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtgggcctgagtgaggtctctgcaaggcttcnggctacaccttcaccggcgactatcctccacgtgggtgcgacacggcccctaggacgaagggtcttggaggtggagtgggatggactacaaacccctaacagtggtacggacaacgaaactgtcgacaacgaagtaacgtttcgagggacgtaacggggtccaaccgtaagtacggaaccgtaacggggaacctaaccggtacccaagtaccgaacggaccaaaccgacgacccgttaaacgagtacgggacggacctagggaacgacgaaacgaaccgttaggaaccgtaacttaccggtaacggaacccggaaccgtacccgggtaaccttaaagttttaacgttaaccgtggttacggaacgtaaggttaacgtttacgggtttaccggtcggttacgtttcggtttttacccgg

SEQ ID NO: 349550 - DNA, 567 bp, Homo sapiens
  misc_feature: GZ8MTXP02GYBNU.45.37.D04.1.454.CMB.2.raw
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (286)..(286): a, c, t, g, unknown or other
  misc_feature (286)..(286): n is a, c, g, or t
  modified_base (326)..(326): a, c, t, g, unknown or other
  misc_feature (326)..(326): n is a, c, g, or t
  modified_base (481)..(481): a, c, t, g, unknown or other
  misc_feature (481)..(481): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggagcctggggcctnagtgagtctctgcagctngctacnctcaccggnactatctcatggtancgacncggcccnggacaggcttgagtggatgggatggatacaaccccctaanaagtggtcggacaacaaaactgtacgacaactaaggtaagtttcgaagggggtcaaggggtaccaaaccgagtacggaaaccgaagggggaacaccggtaccaagtccagacaacgtacgaccctagagtgggaagcagagcgtaagactgactntacacgacggacaccggacttaactttataacgtgtacgaaggtaagtacgttacggtttacggtcggtcgtttcggtttttaccg

SEQ ID NO: 349551 - DNA, 704 bp, Homo sapiens
  misc_feature: GZ8MTXP02IUXQZ.45.37.D04.1.454.CMB.2.raw
  modified_base (367)..(367): a, c, t, g, unknown or other
  misc_feature (367)..(367): n is a, c, g, or t
tcagacgcgatcgacacgaccggtgctcgatttagtagcatactgttgggtttgggggagagcatcaccccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctgagtgaaggtctcgtgcgaaggcttctggctacaccttcgacccggcgactactcctccacgtgggtgcgacacggccccgtaggacgaagggcttaggaggtggacgtaggggataggactacccaaacccctaanaagtggtacgacaaccaatagtagacacgaagtaagtttacgagggcgtaacgggtaccaacgtaacgtacggaaccgacggggaccaccgttccaataccgacgacaaccgaccgtaccgtaactacgggtacggacgtacgtacggaacgacgtaaacggtacgtaacgtaacgtacgtttaaccgaaccggtaaacccggtaacccgggtaccggttacccttttaaacgtttaaacgtttacggttacggggtaacggtacgggttaacggggttacggttttaaccgggggtttaacccgggttaggttttccggggtttttttacccgggg

SEQ ID NO: 349552 - DNA, 611 bp, Homo sapiens
  misc_feature: GZ8MTXP02JWVE8.45.37.D04.1.454.CMB.2.raw
  modified_base (254)..(254): a, c, t, g, unknown or other
  misc_feature (254)..(254): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcagtgaaggtctcctgcaggcttcnggctacaccttcaccggcgactatctccacgtgggtgcgacacggccccgtggacgaagggcttgagtggatgggatggactaccaaccctaacacgtggtacggcactaactatgcacagaggtttaccaggggacagggtacaccgagtacgacgacgggaccacgtaccagtacacgacacacgacctacgagtgggaacgtcgaggacgacgaaggaccgtagtactaagtctacggaacgaccgaaccgggaccttaacgttttactttaaccggtaggttcggtacccggtaagggttacggtttacccggggtttaaccgggggttcgggttaccggtttttaccggggg

SEQ ID NO: 349553 - DNA, 704 bp, Homo sapiens
  misc_feature: GZ8MTXP02IR1H6.45.37.D04.1.454.CMB.2.raw
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtgggcctcgagtgaaggtctccgtgcaggtcttcnggctacnccttcgaccggcgactatcctccacgtgggtcgcgacgacggcccctggaacgaagggtcttggaggtggagtgggatggaactaccaaacccccgtaagagtgggtagaccaacgaaactgtgacaacgtaagtacgtttacggacggggtactacggggtacaccgagtaccggaaccggaacggggacaccggtacacgtacgacgccgaaacgaccggtacctaacggtacgtacgggacgtacgacgggacgaccgaacggtaaccttaggaaacctacgttaccggttacggaaacccgtaaaccggtaacccgggttaaccctttaaaggttttacctttaaccggttaggttaacgggaaccggttaagggttacgttttaccggggtttaaccggggttcggtttaaccggtttcggtttttttaaccccgggg

SEQ ID NO: 349554 - DNA, 571 bp, Homo sapiens
  misc_feature: GZ8MTXP02FPYFE.45.37.D04.1.454.CMB.2.raw
  modified_base (344)..(344): a, c, t, g, unknown or other
  misc_feature (344)..(344): n is a, c, g, or t
  modified_base (366)..(366): a, c, t, g, unknown or other
  misc_feature (366)..(366): n is a, c, g, or t
  modified_base (439)..(439): a, c, t, g, unknown or other
  misc_feature (439)..(439): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctgggcctcagtgaggtctcctgcaggcttctggctacaccttcaccggcgactatcctccacgtgggtgcgacacggcccctggacaagggcttggagtggagtggggatggactccaaaccccctaanaagtggtaggacaacgaaactntgacaacagtaagtttcgagggcaggggtcaaccgagtacgaccgagggacacgtcatcagcacagaccctanagtcggaagcgtgagcgagacctagaaccgtatacgacggaccgaacaccggaccttaagttttacgttacgtggttacgaacggtaggtacgttacgggtttaccggtggttcgtttcggtttttacccgg

SEQ ID NO: 349555 - DNA, 627 bp, Homo sapiens
  misc_feature: GZ8MTXP02GL6G9.45.37.D04.1.454.CMB.2.raw
  modified_base (379)..(379): a, c, t, g, unknown or other
  misc_feature (379)..(379): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtgggcctcagtgaaggtctctgcaggctcgtgctacacctcgaccggcgactatcctccacgtgggtgccgacgacggcccccgtaggaaccgaagggtcttggaggtgggagtggggatggactaccaacccctaacgagtggtcggacaacaaactntagacaacagtaagttcgagggcagggtcacagtacgacgagggacaccgtcagtcgagcacgacgacctacgagtcggagtccgtaggacgaccgaaggtacctaggaacctacgttacgtacggaaccgaaccgtaaccgggtaccttaatttttaacgttaaccgttggtaccggtaacggttaagggtacggttttacgggtttaacccgggtcgggtttaccggtttacggggttttttcccg

SEQ ID NO: 349556 - DNA, 665 bp, Homo sapiens
  misc_feature: GZ8MTXP02GYVXH.45.37.D04.1.454.CMB.2.raw
  modified_base (253)..(253): a, c, t, g, unknown or other
  misc_feature (253)..(253): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtgggcctcagtgaaggtctcgtgcgaggcttcgnggctacaccttcgaccggcgtactactcctccgtacgtgggtcgcggacgaccggtccccgtagggaaccgaacggggtcttaggacgggtggggagttcggggaattcgggaactaccgaaaacccccccgtaaagaagttcggggtacggaaccgtaaaccaaaacgttacgtacgaccgaaaccgtaagtaaacggtttacgacggggtacgtacggggtaccaacccgtagtacggacgacggggaactaccggtcataccgacgaccgaccgacgacctaacgtagtagggacgtcgtagacgacagactgaactgtaccgtacgaccgacgaccggtacttacgtttaccgtagtgttagaacgtaggtacgttacggttacggttcgtcggtttcggttttaccg

SEQ ID NO: 349557 - DNA, 584 bp, Homo sapiens
  misc_feature: GZ8MTXP02FQ536.45.37.D04.1.454.CMB.2.raw
  modified_base (266)..(266): a, c, t, g, unknown or other
  misc_feature (266)..(266): n is a, c, g, or t
  modified_base (290)..(290): a, c, t, g, unknown or other
  misc_feature (290)..(290): n is a, c, g, or t
tcagacgcgatcgacacgaccggtgctcgatttagtagcatactgttgggtttgggggagcattcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctgggggcctcgagtgaaggtctcctgcaaggcttctggctacaccttnaccggcgactatctccactgggtncgacaggccccagtggacaagggctttgagtggatggggatgggatccaacccctaacaatggtggacaacaactatgacacagtaagtttcgagggcagggtcacatgaccgagggacacgtcgatacgagactaccgagccctaacgatagggagccgttaggaagccgaaggactaggactaacgtcgtaggaaccgaccgaaaccggtcctaaagtttttactaacgttcggtaacggtaccggaagggtactttacgggtttaacccgggtcggtacgtttttccgggg

SEQ ID NO: 349558 - DNA, 662 bp, Homo sapiens
  misc_feature: GZ8MTXP02JPEOG.45.37.D04.1.454.CMB.2.raw
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagccccactccccaggtgcagctggtgcagtctggggctgaggtgaggaagccgtggggcctcagtgaaggtctcctgcaaggcttctggctacaccttcaccggcgactatctccactggggtgcgacacgggccccctggacaaggggcttggaggtggagtggggatgggactaccaaaccctaaccgaaagtcgggtaggccaacaaaactatcgcaacgaagtaagtttcgaggggtacacggggtccacgtagtacgaaccgacgggaccgaaccgtccaacgtcaacgccaacgacggaccctaacgacgttagggacgcgtaggaccgcgaacggtacgtaggaacctagtaccgtacggaaccggacgacccgggtaacctacgtttttaaacttaccgtttagtacggtaccggtaagggtacgtttacggttttaaccccggggttaggtccgttttcggggttttacccttttttaaccgggggg

SEQ ID NO: 349559 - DNA, 539 bp, Homo sapiens
  misc_feature: GZ8MTXP02IFBVP.45.37.D04.1.454.CMB.2.raw
  modified_base (342)..(342): a, c, t, g, unknown or other
  misc_feature (342)..(342): n is a, c, g, or t
  modified_base (358)..(358): a, c, t, g, unknown or other
  misc_feature (358)..(358): n is a, c, g, or t
  modified_base (432)..(432): a, c, t, g, unknown or other
  misc_feature (432)..(432): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggaagcctggggcctcagtgaggtctcctgcaaggcttctggctacaccttcaccgacgactatcctccactgggtgcgacaggccccctggacaagggcttgagtggatgggatggatcaaccccctaanaatggtgcacaaactntgcacagtaagtttcagggcagggtcacccatcgaccagggacacgtacatcagcacacgcctacataggacgntcgagcagacgtgaaccatacgtcgacgacgaccgggtacctaatttacttaactggttagcggtaaggtacttaggtttaccggtcgggtcgtttcggtttttccg

SEQ ID NO: 349560 - DNA, 682 bp, Homo sapiens
  misc_feature: GZ8MTXP02I3EJE.45.37.D04.1.454.CMB.2.raw
  modified_base (249)..(249): a, c, t, g, unknown or other
  misc_feature (249)..(249): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagcctgggcctcagtgaggtctctgcaaggcttcnggctacaccttcgaccggcgactatcctaccactgggtgcgaccacggccccgtaggacaagggtcttaggaggtggagtgggatgggactaccgaacccctaaacgagtcggtacggacaacgaaaactgtacgacaacgtagtaagtttcgaaggggcgaaggggttacccaaccgacgtacggaaccggacggggaacaccggtaccaagtccgaagccaaacgacgtacctaacgacgtacggagaccttaggcgaccgaaggtacctaggtaacctagttaccgtaacggaaccgggaaaccaaccggggtacccttaaaactttttcgttaaaccgtgggtttacggaaccgggttaaggtacggtttaccgggggttttaacccggggttgggggttttaccggttttacgtttttaacccggggg

SEQ ID NO: 349561 - DNA, 595 bp, Homo sapiens
  misc_feature: GZ8MTXP02HNO6J.45.37.D04.1.454.CMB.2.raw
  modified_base (476)..(476): a, c, t, g, unknown or other
  misc_feature (476)..(476): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactcccaggtgcagctggtgcagtcgtgggctgaggtgaggaagccgtgggcctcgagtgaaggtctcctgcaaggtcttcgtggctactaccttcgaccgggctactactcctccgacgtggtgccgacgacggccccgtaggaacgaagggtcttaggacgtggagtgggatggactaccaaaccccccgtaagaagtggtacggacaaacgaaacttgcgacaacgagttaacgttcgagggacgagggtcaccgagacggaccgaagggtaccacgtaccaagcgagcaacacgacctanagcggagccagacgcgtaacgcgacgatactaccgacgaccgaccacggtaccttatttacgtacgtgtacgaagtaggtacgtttacggttacgtcggtcgttttacggtttacccgg

SEQ ID NO: 349562 - DNA, 597 bp, Homo sapiens
  misc_feature: GZ8MTXP02GN56U.45.37.D04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctgaggtgaggagcgtgggctnagtgagtctctgcagctcgngctacaccttcgaccggcgtactactcctccgacgtgggtcgcgacgaccggccccgtaggaacgaggtcgtaggaggtggagtgggatggactaccaaacccctaagagtggtacgacaacaactgtagacacgtaagtacgttacggagggtacgtacggtacaaccgtagacgaaccgacggtacaccggtcaacgtcgacgaccacgacgacctacgagtcggacgcgtagacgacgagtacgtcgactacgtcgtacggaccgaacaccggtacttaacgttacgtacggtgtacggaaccggtaggtacggtttaccggttcggtcggttcggtttacggtttttccg

SEQ ID NO: 349563 - DNA, 601 bp, Homo sapiens
  misc_feature: GZ8MTXP02HY8D7.45.37.D04.1.454.CMB.2.raw
  modified_base (222)..(222): a, c, t, g, unknown or other
  misc_feature (222)..(222): n is a, c, g, or t
  modified_base (366)..(366): a, c, t, g, unknown or other
  misc_feature (366)..(366): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggagctgggctnagtgagtctctgcaggtctctggctacacctcaccggcactatcctccacgtggtgcgacgcggcccctggaccaagggtcttcggagtggagtgggattcggataccaaacccctaagaacgttgggtagactaacaaacgtntcgacaacagtaaagtttcgagggcgtagggtcaaccgagtacggaccaaggggacacgtccagtcagcacacgcctacaagtggagaccgtagacgcgtaaacggcttacgaacgtaattcgtacggaaccgtaacgaaccggtccttaaattttacgttaacgtggttacggaaccggttaggtaacgtttacgggtttaaccggttcgggttacgttttacggtttttccgg

SEQ ID NO: 349564 - DNA, 638 bp, Homo sapiens
  misc_feature: GZ8MTXP02FQS91.45.37.D04.1.454.CMB.2.raw
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggaagccgtggggcctcagtgaggtctctgcaaggctctggctacaccttcaccggcgactactcctccacgtggggtncgacncgggccccctggacgaaggggtcttggaggtggagtggggatagggactacaaacccctaaagaacgtgggtacggaccaaacaaaaccttatcgacaacgaagtaacgtttcgaaggggcgaaggggtcaccctagtagaacccgaaggggaccaccgtccaatacgagaccacacggaccctaacgagtggggacgccgtagaacgcgaaacggactaggactaagttccgaacggaaaccgacgacccggtaccttagtttttaaactacgtacgtggacggtaagggttaactttcggggttttaccggcggttcgtttaccgggttttccttttaacggg

SEQ ID NO: 349565 - DNA, 699 bp, Homo sapiens
  misc_feature: GZ8MTXP02JQH10.45.37.D04.1.454.CMB.2.raw
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcaaggcttcgnggctacnccttcgaccggcgactatcctccgacgtgggtcgcgacgacggccccgtggaccgagggtcttggaggtggagtgggagtggactaccgaaacccccgtaacgtaacgtgggtacggacaaaccgtaaactcgtacgacgaaacgtaaggtaaacgtttacggaacggggtaccggtaaacgggggtacccaaacccggtaacgttaccggaaaacccgggtaacgggggaaccctaacccgggtacccaaacgttacccgaaacgacccgaaccgaaccggtaccctaacgtagtacgggacgccgtaggacgaccgagtacgtacggactagttccgtacggaacgaccgacggtacccttaagtttactaaccgtggtacgaacggtaggttacgtttacggttccggtacgttccgtttcggtttttcccgg

SEQ ID NO: 349566 - DNA, 628 bp, Homo sapiens
  misc_feature: GZ8MTXP02JD8W6.45.37.D04.1.454.CMB.2.raw
  modified_base (259)..(259): a, c, t, g, unknown or other
  misc_feature (259)..(259): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaaggtctctgcaaggattctggctacnccttcaccggcgactatctccacgtggtgcgacgacggcccctggacgaagggcttgagtggagtgggatggactaccaaaccccctaagaagtgggtacggacaaccaaaactgtcgacaacgaagtaacgtttcgaaggggaccgaacgggggtacaacccgaagtacggaaccaagggggacaccggtaccaatacgacgacaacgacgacccgtaacagttacggagtccgtagacgacaagtaccagactacgtacgtacggaaccgacgaaccggtaccttattttaacttaaccgtggttacggaaccggtaaggtaacgtttacggtttaccggttggtaccgttttcgggtttttaccgg

SEQ ID NO: 349567 - DNA, 599 bp, Homo sapiens
  misc_feature: GZ8MTXP02GDHBU.45.37.D04.1.454.CMB.2.raw
  modified_base (458)..(458): a, c, t, g, unknown or other
  misc_feature (458)..(458): n is a, c, g, or t
  modified_base (473)..(473): a, c, t, g, unknown or other
  misc_feature (473)..(473): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaggcttctggctacaccttcaccggcgactatcctccacgtgggtgcgacgacggccccctggacgaagggcttgagtggagtgggatggactaccgaaccccctaacgaagtggtaggacaacgtaaactgtgacaacgagtaagtttacgacggggacgtacggggtccaaccgagtacgaaccgaggacacgtccatcagcacacgaccctanacgtaggacgctagngactagactagactacgtcgacgacgtaccgaccggtacttaactttacgttacgtcggttacgaaccggtaaggtacgtttaccgggtttaccgggtcggtttacgtttacgggttttttcccgg

SEQ ID NO: 349568 - DNA, 634 bp, Homo sapiens
  misc_feature: GZ8MTXP02FWBNY.45.37.D04.1.454.CMB.2.raw
  modified_base (252)..(252): a, c, t, g, unknown or other
  misc_feature (252)..(252): n is a, c, g, or t
  modified_base (368)..(368): a, c, t, g, unknown or other
  misc_feature (368)..(368): n is a, c, g, or t
tcagacgcgatcgacacgaccggtgctcgatttagtagcatactgttgggtttgggggagcatcacccagcaaccacatctgtcctctagaaaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttcgnggctacaccttcaccggcgactactctccagtgggtgcgacacggcccctggacaaggggtctggagtgggatggggatgggactcgaaacctaccaagtggtagacacaaaactntcgacacagacgttcgagggcgagggtacaccgagtacgaccgtaagggaccacgtacccatcgacgacctacgacggtccctaagacttagggacgtcgtagaacgacgaacgacgtaggaactagttacgacgaaaccggtaccaaaccggggtaccttaaacgtttaagtttaacccgtgtaccgggtacggtaaccgggttagttaccgggttttaccgggtacggggttacttttccggggtttccgtttttaaccggggg

SEQ ID NO: 349569 - DNA, 596 bp, Homo sapiens
  misc_feature: GZ8MTXP02IZV45.45.37.D04.1.454.CMB.2.raw
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (285)..(285): a, c, t, g, unknown or other
  misc_feature (285)..(285): n is a, c, g, or t
  modified_base (496)..(496): a, c, t, g, unknown or other
  misc_feature (496)..(496): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctgaggtgaggagcgtgggcctnagtgagtctctgcaggtcttcnggctacnccttcgaccggcactactcctccacgtgggtnccgacgacggccccgtaggaacgtaagggtcttaggagtggagtgggatggactaccaaacccccgtaagaagtgggtacgacaaactaaactgtcgactaaacgaaagtaacgtttcgaagggacgtacgggtaccaaccgtagacggaaaccggaggaaccgtaccgtacaacgacgacactaaccgacgacctaacgagacgagcagngacaggtacagaactatcgacgacgacgaccgtacttatttacgtacgtgtacggaaggtaagtacgtttcggttacggtcgtcgtttacggttttaccg

SEQ ID NO: 349570 - DNA, 661 bp, Homo sapiens
  misc_feature: GZ8MTXP02H5NQD.45.37.D04.1.454.CMB.2.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
  modified_base (283)..(283): a, c, t, g, unknown or other
  misc_feature (283)..(283): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagcgtgggcctnagtgaggtctcngcaggctctgctacnctcgaccgnactatccnctagtggtcncgacacggccccgtaggacgaagggtctagggagtggatggggataggactacccgaaaccctaagagtaggtacgaaactaaactgtacgacgtaaacgtaagttaacgttacgaggggtaccgtaacgggtaccaacccgtagtaccggaaacccggaggggtaaaccctacccggttacctaacgtaccgaacgtaccaaaaccgtacgtaccccgttaaagagtacgggaacttccgtaggaaccgacgtaacggaactcggaaactcgtaccgtacggaccgaccgtaccggtacctttagtttaacgtccggtagtacggtaaggtaggtacggtttacggtttacgggtcgtttgtttacggtttttccgg

SEQ ID NO: 349571 - DNA, 674 bp, Homo sapiens
  misc_feature: GZ8MTXP02IWBYO.45.37.D04.1.454.CMB.2.raw
  modified_base (249)..(249): a, c, t, g, unknown or other
  misc_feature (249)..(249): n is a, c, g, or t
  modified_base (401)..(401): a, c, t, g, unknown or other
  misc_feature (401)..(401): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcagtgaaggtctcctgcaggcttcgngctacaccttcaccggcactatcctccacgtgggtcgcgacgacggccccctaggaaccgaaggggtctttaggaggtagggagtggggagtagggactaaccgaaaacccctaaaccgaaagttcggggtagaccgtaaacaaaacgttancggacaacgaagttaacgtttcggaacggggacgtagggtaccaacgtacgtcgaacccgagggacccacgtacccatacaacgaccaacgaacgaccttaacgagtggaacgtccgtaggaacgcgtaaacggactaacgactacgttacgtacggaaaccgtaccgaaccgggtacctttaaacgtttacgttacgtaggtacggtacgtaaggtacgtttacggtttaccggggtggtaccgttttcgggtttttacccttttaacgggg

SEQ ID NO: 349572 - DNA, 665 bp, Homo sapiens
  misc_feature: GZ8MTXP02GIQUG.45.37.D04.1.454.CMB.2.raw
  modified_base (284)..(284): a, c, t, g, unknown or other
  misc_feature (284)..(284): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctgagtgaggtctctgcagcttctggctacacctcaccggcactatcctccagtgggtnccgacgacggcccctggacgaagggtcttggaggtggagtgggatggactaccgaaaccccctaagaacgtgggtacggacaacgtaaacgtgtacgactaacgtaaggtaacgtttacggaacgggtacgtacggggttaccaaccgtagtaccgggaaccgaaaggggtaccaaccggttacgaacgtccgaacgaccgaaacgaccggtaccctaactacggttagggacgtcgtacgaggaacctagggacttacggaactagtaccgtacggacccgtaacgaccggtaaccttacgttaacgttacgtggttacggaacggtacgtaacggtttcgggtttaaccggtcggttccgtttacggtttttacccggg

SEQ ID NO: 349573 - DNA, 651 bp, Homo sapiens
  misc_feature: GZ8MTXP02IYKIL.45.37.D04.1.454.CMB.2.raw
  modified_base (354)..(354): a, c, t, g, unknown or other
  misc_feature (354)..(354): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagccgtggggcctcagtgaaggtctcctgcaaggcttcgtggctacaccttcaccggcgactatctccactgggtgcgacacggcccctggaaccgaagggcttggagtggacgtgggatggataccaaacccccgtaanaagtggtacggacaaacaaaactgtagaccaaacgtaagtaagtttacgaaggggaccgtaacggggtaccaaacccgtagtacggaacccggaacggggaaaccaccggtacccaagtaccgaagccaaacgacgacccgtaacgagtacgggagtcgtacgagacgaagtacgacgactacgtacgtacgaacgaccgaacggtaccttaaatttacgttaaccgttaggtacgtaaccggtaaggtacgtttacgggtttaaccggtcggttacggtttacggtttttcccggg

SEQ ID NO: 349574 - DNA, 701 bp, Homo sapiens
  misc_feature: GZ8MTXP02JMGGZ.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggagcctggggctcagtgaaggtctcctgcaaggcttctggctacaccttcaccggcgactatctccactgggtgcgacacggcccctggacaagggcttgagtggagtgggatggatacaaaccccctaacaagtggtacggacaacgaaactagtgacaacgagtaaagtttcggaaggggtcgaacgggggtccaacccgaagtacggaaccgaagggggaaccacggttaccaagtaccgacggaccaaacgacggtaccctacgaagttacgggacgaccgttaggaacgacccgaaggtaaccgtaggtaaaccacgttaccgtacggaaacccggaaacccggacccggggttaaaccccgttaaactttttaaccgttaccggtttaggtacggggtaaccgggtaaggggttaacggttttaccggggttttacccggggttacgggtttcccggtttaacgggggtttttttacccccgg

SEQ ID NO: 349575 - DNA, 553 bp, Homo sapiens
  misc_feature: GZ8MTXP02JSAJS.45.37.D04.1.454.CMB.2.raw
  modified_base (370)..(370): a, c, t, g, unknown or other
  misc_feature (370)..(370): n is a, c, g, or t
  modified_base (458)..(458): a, c, t, g, unknown or other
  misc_feature (458)..(458): n is a, c, g, or t
  modified_base (475)..(475): a, c, t, g, unknown or other
  misc_feature (475)..(475): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagctggggcctcagtgaaggtctcctgcaaggcttctggctacaccttcgaccggcgactatcctccacgtgggtcgcgacacggcccctggacgaagggcttgagtggagtgggatggactacccgaaccctaacaagtgggtggacaacaactntagacacaagtacgtttcgagggcgagggtaccacgatcgaccgaggaccacgtacccatacagaccacgacgcctacgagtcggaancgtagagcagactgacngtcgacgacgacgaccgtactatttacgtactggtaacgcgtaaggtacttacggtttaccggtggtcgttttccggg

SEQ ID NO: 349576 - DNA, 611 bp, Homo sapiens
  misc_feature: GZ8MTXP02GN72B.45.37.D04.1.454.CMB.2.raw
  modified_base (292)..(292): a, c, t, g, unknown or other
  misc_feature (292)..(292): n is a, c, g, or t
  modified_base (346)..(346): a, c, t, g, unknown or other
  misc_feature (346)..(346): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcgtggggcctcgagtgaggtctctgcaaggcttcgtggctacaccttcaccggcgactatcctcctacgtgggtncgacacggccctggacaagggctgagtggagtgggatggatacccaaacctaanaagtggtacggacaacaactatagacaacgagtaagtttcgaggggacacgggtacaacagtacgaaccgagggaccacggtccaagtacacgacacacgacctacgagttagggataccgtagacgcgaacggtacctagaacgacttacgacggaaccggtaaccgaccgggtaacccttaagttttaacgtaccgtaggttaacggaaccggtaaggttacgtttacgggtttacccgggtcggtttaccgtttttccgggg

SEQ ID NO: 349577 - DNA, 620 bp, Homo sapiens
  misc_feature: GZ8MTXP02HOA6F.45.37.D04.1.454.CMB.2.raw
  modified_base (254)..(254): a, c, t, g, unknown or other
  misc_feature (254)..(254): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggaagccgtgggcctcagtgaaggtctcctgcaaggtcttcgnggctacaccttcaccggcgactactcctccacgtggtgccgacgccggcccctaggaacgaaggtcgttaggagtggagtgggatggactacgaaacccctaacgtaagtggtacgacaaacaaactagtcgacaacgaagttaacgttcgaagggtacgacgggtaccaacgtacgtacggaaccgaacggaccacggtaccacgacacgacactacggaccctatagacggactagacgacgacgacgtacgacgaacgtactacgacgaaccgacgacggtaccttaaagtttactaaccgtagtaccgtaacggtagttacgtttacggttacccggtggttaccgttttcggttttaccgg

SEQ ID NO: 349578 - DNA, 682 bp, Homo sapiens
  misc_feature: GZ8MTXP02GHA4R.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactccccaggtgcagctggtgcagtcgtgggctggaggtgaggagccgtgggcctcgagtgaggtctcgtgcaggcttcgtggctactaccttcgaccggcgactacgtcctaccacgtgggacgccgacgaccggcccctaggacgaagggtcttggaggtggagtggggaatggactaccaaaaccccctaagaagtggtacggacaaactaaatctacgacaaacgtaggttaacgggtttcggggacgacgggtacaacccgtagacggaaccggtacgggaacctaccggtaccagtaccgacgaccaacgtacgaccctaagtaggtggtaacggtcctaaggacggaacacgggactacggaactacgttacggaacgtaccgggaaccgtaccgtaccgttttaaatttaacgtttacccgtaggtcggtaacggtaacggtacggttttacgggtttacccgggtggtttccggtttacggtttttcccgttttaacgggg

SEQ ID NO: 349579 - DNA, 720 bp, Homo sapiens
  misc_feature: GZ8MTXP02I4D38.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcgtggggcctcagtgaaggtctcctgcaaggtcttctggctacaccttcgaccggcgactatctccacgtgggtgcgacgacggcccctagggaacgaacggggtcttacggaggtgggaagtcgggagtggaactaccgaacccctaaacgaagtgggttacggactaaacccaaagtagtacgacctaaaccgtaagggtaacgtttccggaaacggggacggtaaggggttacccaacccgtaagtacggaaacccgaacgggggtaccaaccggtaccctaacgtaccgagaccacgaaccgtacctaacctagtacgggacgtacgtacgaacgacgaacgacgttagaacacgtacgtaacggaccggaaacccgtaccggggttaaccttaaacgttttaacgttaccgttaaggttcggtaaccgggtaaggtttaccggtttacgggttttaaccccggggtttaggtttcccggtttttacggggttttttacccgg

SEQ ID NO: 349580 - DNA, 533 bp, Homo sapiens
  misc_feature: GZ8MTXP02IKKVQ.45.37.D04.1.454.CMB.2.raw
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
  modified_base (319)..(319): a, c, t, g, unknown or other
  misc_feature (319)..(319): n is a, c, g, or t
  modified_base (340)..(340): a, c, t, g, unknown or other
  misc_feature (340)..(340): n is a, c, g, or t
  modified_base (413)..(413): a, c, t, g, unknown or other
  misc_feature (413)..(413): n is a, c, g, or t
  modified_base (426)..(426): a, c, t, g, unknown or other
  misc_feature (426)..(426): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagccactcccaggtgcagctggtgcagtcgtggggctgaggtgaggagcctgggcctgagtgaagtctctgnagctngctanctncgnactatcncntggtncgangccnagganaaggcttgagtggatgggatggatacccaaaccctaanaagtggtagacaacgaacttnacgacacaagtagtttcgaggacgtaggtaccactagacgaaccacgggtacacgtcaagacacgacacgacnctacgagtacgancgagagagtacgacgagacactacgtacgacgacgacgtacttacgtttaacgttacgtagtaacgtacggtacgtacgttacggtttacggttacggttcgtttcg

SEQ ID NO: 349581 - DNA, 676 bp, Homo sapiens
  misc_feature: GZ8MTXP02IY2M3.45.37.D04.1.454.CMB.2.raw
  modified_base (253)..(253): a, c, t, g, unknown or other
  misc_feature (253)..(253): n is a, c, g, or t
  modified_base (289)..(289): a, c, t, g, unknown or other
  misc_feature (289)..(289): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgagtgaggagccgtgggcctcagtgaggtctctgcaggcttctggctacnccttcgaccggcgactatctccacgtgggtgcgacnggcccctggacgaaggcttgagtggatgggatggactccgaaaccccctaacgaagtcgggtaggaccaaacgaaaacctgtacgacaaacgtaagtaaacggtttacgaagggggcgtaagggggttaccaacccgaagttacggaaacccgaacgggggtaaaccgacccggttacccaacgtaccaacggaccaaacgtaaccgacccgtaaacaagttacgggacgtcgtaacggacggacaacggacttacggaactacgtcgtacggaccgaaaccgtaccgggtacccttaaagttttacttaaaccggtggttaccgtaacgggaggttacgttacggggtttaaccggtcggttaccggtttcgggttttttacccgg

SEQ ID NO: 349582 - DNA, 676 bp, Homo sapiens
  misc_feature: GZ8MTXP02HBB0X.45.37.D04.1.454.CMB.2.raw
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
  modified_base (334)..(334): a, c, t, g, unknown or other
  misc_feature (334)..(334): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggaagccgtggggcctnagtgagtctcngcaggctcnggctacnctcaccggcactatctcatggtnccgacncggccctggacagggtcttggagtggagtgggatggatacaacccctaanagtggtacgacaaactaaactgtacgacaacgtaagttaacggtttacgacggggtacgtacggggtaccaaccgtagtaccggaaccgtaacggggacctacccggttaccgaacttaccgaacggaccaaaccgaaccgtaacccgttaacgaacggttagggaacgtaccgtaggaaccgacggaacgacgtacggaacacgttacgacggaacccgtaccggtaacccggtaccctttaaagttttacccgttacgttacgggtacgtaacgggtacggttaacggttaccggggtttaaccgggttcggtttaccggttttcggtttttacccgggg

SEQ ID NO: 349583 - DNA, 668 bp, Homo sapiens
  misc_feature: GZ8MTXP02IN5JT.45.37.D04.1.454.CMB.2.raw
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctgggtgcagtcgtggggctggaggtggaggaagccgtgggcctcagtgagtctcngcagtctngcactcctcaccggcactatcctccacgtgggtgccgacgacggccccgtggaacgagggtcttggaggtggtagtggagtggactacccaaacccctaacgaagtcgggtacgaacaaacgtaaactgtacgactaaacgtaagttaacggttacggaacggggcgtaacggggtaccaaccgttaacgaccgggaacccggaacggggtaacccaacccggttaccaaacgaccgaaccggaccaaaccgacgtacccgtaaaccgtaggttacgggacgtaccgtagacgaacgacgtaactagacctagtaccgtacgaaccgtaacgaccgtaccttattttacgtagtacgtacggtcgtaaagggtttcgttacggtttaccgggtcggtttcgtttaccggtttttccgg

SEQ ID NO: 349584 - DNA, 648 bp, Homo sapiens
  misc_feature: GZ8MTXP02F1MEN.45.37.D04.1.454.CMB.2.raw
  modified_base (265)..(265): a, c, t, g, unknown or other
  misc_feature (265)..(265): n is a, c, g, or t
  modified_base (375)..(375): a, c, t, g, unknown or other
  misc_feature (375)..(375): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggggctgaggtgaggaagccgtgggggcctcagtgaacggtctccgtgcaaggcttcgtggctacnccttcgacggcgactatctcacgtggtcgcgacgacggcccctggacgaagggtcttgagtggagtgggatggatacaacccctaacgagtggtcggacaacgtaaactntcgacgtaacgaagttaacggtttacgaaaggggcgtaacggggtccaaacccgagtacgaaacccgagggggaaaccctaccggtaccctaagtccgacggacctaaccaaccggtacctacgaagtcgggaacgcgtaggacgcgaacggtaaccgagaactacgtcgtacgaaccgtaaccggacgttaactttaacgtttacgtacggtggtacggaacggtaacgttacgttccgggtttacgtcgggtttccgtttacggttttccg

SEQ ID NO: 349585 - DNA, 655 bp, Homo sapiens
  misc_feature: GZ8MTXP02GEG22.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctctgcgagcttctggctacaccttcgaccggcgacctatctccacgtgggtgacgacgacggccccgtaggacgaagggcttagagtggagtgggatagggactaccgaaacccctaaactagtaggtacggacaaactaaaacctgtacgaactaaacgtaagtaacgtttacggaaggggacgtaaacggggtacccaaaccgactacggaaccgaaacggggaaccctaccggtaccacaccgaacggcaaaccgaacggaccctaacgaagtgggaacgacgacgacgtacaacggtaccaggaaactacgtcgaacgaccgtaaccgacggaaccttaactttacgttaactggtacgaagtaaacggtacgtttacgggttaccggtcgtcggtttacggtttttaccgg

SEQ ID NO: 349586 - DNA, 719 bp, Homo sapiens
  misc_feature: GZ8MTXP02FM4YP.45.37.D04.1.454.CMB.2.raw
  modified_base (329)..(329): a, c, t, g, unknown or other
  misc_feature (329)..(329): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgccaaagtccagccagagttgtttagacagctaccaaacaataagaactacttagcttacggtaccagacaacgaaaccagtcacgcctactaagctagctactatttacgngggactacgtaccgtaacccggggaacgtcccggggtccccctacggaccgtacttcgagggtcggcgtacggggtcgggtcgtacggggactaggttactttaccacgttaccctacaaaccctagtaccgaaacgccgaccgtcccgttagaccggtacggtacgtaagtaaagggtcgttggtaacggtcgttaagtttttacggtgtacttcgggtacaagttaactaaatttaattttacttaactttaacctttccccggttacggttaacccttttaccccggggtacccggtaacggggttaaaaccctaaggggttacggtaaactttaaccgtaaaaccggttaaaaccgtacggtttaccggtaaggtccttaaacccg

SEQ ID NO: 349587 - DNA, 575 bp, Homo sapiens
  misc_feature: GZ8MTXP02F8DBY.45.37.D04.1.454.CMB.2.raw
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (262)..(262): a, c, t, g, unknown or other
  misc_feature (262)..(262): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (386)..(386): a, c, t, g, unknown or other
  misc_feature (386)..(386): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagcctggggctnagtgagtcnctgcagctntgcacnctcncgcnctancncactggtncganacggccctggacagggtcttggagtggagtgggatggatcaaacccctaacgagtggtacggacaacaaactgtgacaactagtaagtttcgaggggacagggtccaaccgngtacgaccgagggacacgtcatccgagcacgacgacctacgagtcgggaagctaggacgcgaacgacgtagaaccaagttccgagaccgaaacgtccggaaccttaagtttacgttaccgtaggtacggtaacggtaacggtacgtttacggggtttaaccggtcggtaccgtttcggtttttacccgg

SEQ ID NO: 349588 - DNA, 528 bp, Homo sapiens
  misc_feature: GZ8MTXP02FH0SC.45.37.D04.1.454.CMB.2.raw
  modified_base (359)..(359): a, c, t, g, unknown or other
  misc_feature (359)..(359): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggagtgggatggatcaaaccccctaacaatggtggcacaaactngcaacagaagtttcgaggggcaggggtcaaccatcgacgaggggacacgtcatcacgcacagcctacatggagctgagcagactgacatcgagacgacacggaccctaatttacttaacgtgtcgaacgaggtacttcggtttacggtcggtcgtttggtttttacccg

SEQ ID NO: 349589 - DNA, 524 bp, Homo sapiens
  misc_feature: GZ8MTXP02FL316.45.37.D04.1.454.CMB.2.raw
  modified_base (362)..(362): a, c, t, g, unknown or other
  misc_feature (362)..(362): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatctccactgggtgcgacacggcccctgaacaagggcttgagtggagtgggatggatcaaaccccctaacaatggtggcaacaaactntgcaacagtaagtttcgagggcaggggtcaccatgaccgagggacacgtccatcagcacagcctacatgggagctgagcacgactagacatctacgacgacacggacctatttactactgtgcgtaggtacgttcggttaccggtggcgtttggttttaccg

SEQ ID NO: 349590 - DNA, 524 bp, Homo sapiens
  misc_feature: GZ8MTXP02FKOH1.45.37.D04.1.454.CMB.2.raw
  modified_base (235)..(235): a, c, t, g, unknown or other
  misc_feature (235)..(235): n is a, c, g, or t
  modified_base (362)..(362): a, c, t, g, unknown or other
  misc_feature (362)..(362): n is a, c, g, or t
  modified_base (447)..(447): a, c, t, g, unknown or other
  misc_feature (447)..(447): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
  modified_base (467)..(467): a, c, t, g, unknown or other
  misc_feature (467)..(467): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaggtcncctgcaaggcttctggctacaccttcaccggcgactatctccactgggtgcgacacggcccctggacgaaggggcttggagtggagtgggatggactcaaccccctaacaatggtagcaacaaactntcgacacgagtaagtttcgagggcaggggtcaccgagtagacccgaaggggacacgtcagtcaagcaacagactacagtaggagngngancgagactgacatcgngacgacacgactattagtactgtagcgagtagtcgttaccggtgtcgtgttttaccg

SEQ ID NO: 349591 - DNA, 507 bp, Homo sapiens
  misc_feature: GZ8MTXP02FNIKE.45.37.D04.1.454.CMB.2.raw
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (292)..(292): a, c, t, g, unknown or other
  misc_feature (292)..(292): n is a, c, g, or t
  modified_base (338)..(338): a, c, t, g, unknown or other
  misc_feature (338)..(338): n is a, c, g, or t
  modified_base (426)..(426): a, c, t, g, unknown or other
  misc_feature (426)..(426): n is a, c, g, or t
  modified_base (433)..(433): a, c, t, g, unknown or other
  misc_feature (433)..(433): n is a, c, g, or t
  modified_base (477)..(477): a, c, t, g, unknown or other
  misc_feature (477)..(477): n is a, c, g, or t
  modified_base (498)..(498): a, c, t, g, unknown or other
  misc_feature (498)..(498): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggaagcctgggggcctcagtgaaggtcncctgcaggctcngctacnctcncggcactatctccactggtgcgacaggcccntggacaagggcttgagtgggatggggatggatcccgaacccctaanatgggtggccaacaacctatgcacagtaagtttcaggggcaggggtcaaccatgaacccgaggacacgtccatcagcacaagcctaanatggganctgagcagacctgacatctgacgacaccggccatttactactgngcgaggtatcggtttaccggngtctttcgg

SEQ ID NO: 349592 - DNA, 627 bp, Homo sapiens
  misc_feature: GZ8MTXP02FZJZ9.45.37.D04.1.454.CMB.2.raw
  modified_base (338)..(338): a, c, t, g, unknown or other
  misc_feature (338)..(338): n is a, c, g, or t
  modified_base (392)..(392): a, c, t, g, unknown or other
  misc_feature (392)..(392): n is a, c, g, or t
  modified_base (613)..(613): a, c, t, g, unknown or other
  misc_feature (613)..(613): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgacccagtctccagactccctggctgtgtctcgtgggcgaggacgggccaccatcaactgacaacgtccagccagtagttgtttagacacgctaccaaacaataaagaacttacttagtcgttaggtaaccagacaacgaaaccaggtcacgcctactaagctcgctactatttacgnggctactaccgaccgggaacgtcccgggtcccctacgaccgtatcgagtcgcgngggcggtcgtagggacagtactttcgacttcgtacccaactatacgagccgacgtccctagcgtaggactaggaaagtcgtaggtacgggtacttaagttttgtcggtacctttggacagttaataaatttatttaaacttactttaccttcccgttaccgttaccgttcccggaccgttacgggtaaaacctaggtacgaaattacgaacgtaaaaccgntaggcgtctaaccg

SEQ ID NO: 349593 - DNA, 717 bp, Homo sapiens
  misc_feature: GZ8MTXP02G5BRQ.45.37.D04.1.454.CMB.2.raw
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (597)..(597): a, c, t, g, unknown or other
  misc_feature (597)..(597): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctgaggtgaggaagcgtgggcctgagtgaggtctccgtgcgagcttcgnggctacnccttccgaccggcgactactctccacgtgggtcgaccgacgtaccggcccccgtaggaaccgaaggggtcgtttaggacgggtgggaggttggggaagtacgggaaactaccgaaaacccccctaaacgtaaagtcggggtacggtactaaaccctaaaactacgtacggaacctaacggtaaagttaacggttttacgggaaacgggggtaccgtaacggggttacccgaaacgacgttacggaaacccggtaagggaacccgtaccggttccaataccgacgacccaaacgtaccggaccttaacggaagtcgggactcgtacgacggacgtagaacnggaacacgtcggtaaacgaccgaaccgtaccggacttaacgttttacgtacgttcggtacgtaacggtaggttacgtttacggggtttaccggtggtttccggtttacgtttttaaccgg

SEQ ID NO: 349594 - DNA, 532 bp, Homo sapiens
  misc_feature: GZ8MTXP02IXTYO.45.37.D04.1.454.CMB.2.raw
  modified_base (231)..(231): a, c, t, g, unknown or other
  misc_feature (231)..(231): n is a, c, g, or t
  modified_base (363)..(363): a, c, t, g, unknown or other
  misc_feature (363)..(363): n is a, c, g, or t
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagccccactcccaggtgcagctggtgcagtcgtgggggctggaggtgaggaagcctgggggcctnagtgaggtctcctgcaaggcttctggctacaccttcaccggcgactatctccacgtgggtgcgacaggccccctggacaaggggcttgagtggatggggatggatcaaccctaacagtggtggcacaaactntgcacagagtttcgagggcagggtcaccatgacgagggtacacgtccatcagcacagcctacagtggatcgagacgcgagacctagactaatcgtacgacgacgaccggtacctatttactacgtgtagcgaaggtatcgtttaccggtgtcgttcggtttctttacgg

SEQ ID NO: 349595 - DNA, 553 bp, Homo sapiens
  misc_feature: GZ8MTXP02I8QFN.45.37.D04.1.454.CMB.2.raw
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (340)..(340): a, c, t, g, unknown or other
  misc_feature (340)..(340): n is a, c, g, or t
  modified_base (362)..(362): a, c, t, g, unknown or other
  misc_feature (362)..(362): n is a, c, g, or t
  modified_base (523)..(523): a, c, t, g, unknown or other
  misc_feature (523)..(523): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcagtgaggtctctgcagctntggctacncttcacgcgactatctccactggtgcgacgacggcccctggacgaagggtcttggacgtggagttgggattggataccgaacccctanaagtcggtagcaacgaacttgngacacgaacgtaagtttcgaaacggggtcgtaacggggtcaccgatacggaaccgtagggaacacggtccaagtcacgcacgacgacctacgagttggaacgtcagacgctagctaggacagttcacgacgacgacgtaccagtttacttcgattgaacgngacgttcggttaacgtggtctagttttccg

SEQ ID NO: 349596 - DNA, 673 bp, Homo sapiens
  misc_feature: GZ8MTXP02F1BEY.45.37.D04.1.454.CMB.2.raw
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaacgccgtggggcctcgaggtgaaggtctccgtgacgaaggtcttcgtggctacaccttcgaccggcgtaactactcctaccgagtgggtgccgacgccggccccgtaggaaccgtaagggtcttagggaacggtgggtaagtggggagtaggggacttaacccccgaaaacccgttaacgtaaaggtcgggtacggaaccaacgtaacctagtacgactaaccgaagttaaggtttacgacgggacgacggtacacgatacgacgaaggcacgtacagacacgacacagtacctagacgtagggacgaccgtagacggacgaacgtactaacggtactaacgtaccgtacggaaaccgaccgaaacccgggttacctttaaagtttaacgtacgtacggtaagtacgggaaggtttacgttacgggtttaccggtcggtttacgtttttaccggg

SEQ ID NO: 349597 - DNA, 630 bp, Homo sapiens
  misc_feature: GZ8MTXP02FXDB5.45.37.D04.1.454.CMB.2.raw
tcagacgcgatcgacacgaccggtgctcgatttagtagcatactgttgggtttgggggagctacaacaggcaggcagggggcagcaagatggtgttgcagacccaggtcttcatttctctgttgctctggatctctggtgccgtacggggacatcgtgatgacccagtctccagacctccctggctgtgtctcgtgggcgaggacgggccaccataccaactgacaacgtccagccagtagttgtttagacacgctaccaaactaataaagaacttacttagtcttacggaccagacaagaaaccaggtcacgcctactaagctgctctactttacgtgggacctacgtaccgtacccgggtaacgtccccggggtccccctacgaccgtattcgaggtcggcgcgggtcgggtcgtagggactagtactttcacttcaccacatcagcacgcctgaccgtaggactaggaaagtcgtgggttacggatttagtttagtcgtccgtagtacaagtactaaatttatttaacttacttacctttcccgtaccgttacggttcccggaccgtaacggtaaaccgagttacggaacttaacgaacgtaaaacggtcgttacggacgtactacg

SEQ ID NO: 349598 - DNA, 558 bp, Homo sapiens
  misc_feature: GZ8MTXP02H9X71.45.37.D04.1.454.CMB.2.raw
  modified_base (281)..(281): a, c, t, g, unknown or other
  misc_feature (281)..(281): n is a, c, g, or t
  modified_base (454)..(454): a, c, t, g, unknown or other
  misc_feature (454)..(454): n is a, c, g, or t
tcagacgcgatcgacacgaccggtgctcgattttagtagcatactgttggggtttgggggcatcaccccagcaaccacatctgtcctctagagaatccccctgagagctccgttcctcaccatggactggacctggaggatcctcttcttggtggcagcagccacaagagccccactcccaggtgcagctggtgcagtcgtggggctgaggtgaggaagccgtgggggcctcagtgaaggtctcctgcaaggcttctggctacaccttcaccggcgactanctccactggggtgcgacacgggccccctggacaaggggtctgaggtggagtgggatggatacaacctaacaagtggtcgacaacaaactatgacacagtaagttcgagggacgagggtcaccagtcgacgaggggacacggtccatcgagcacacgctaacgagttgagacgngacgaccgaggactaggacatcacgacgacacggacttactttatacgtagttcgacgtaaggtcttacggtttacggtggtccgttcggtttaccgtttacgg

SEQ ID NO: 349599 - DNA, 630 bp, Homo sapiens
  misc_feature: GZ8MTXP02HGSRU.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaacgccgtggggcctgagtgaacggtctcctgacgtaaggcttcgtggctaccaccttcgacccggcactactcctccacgtgggtgccgacgaccggcccctagggaacgaagggccttggacgggtggagttcggggatacggaactccaaaacccccgtagaagttggacggacaaaccaaagtgtcgaccaagaagttaagttcgaggggacaggggtacaccgtagcgaacggagggacacgtccaatcacgcacacgtacacgtagtcggaacgcgagaccgacgacgacgacgactacgtaccgtacgaaccggacgtaacgtactttaagttacgttacgtacggtacggtaacggttaacgtttacggttacgggtttacggtcggtttacggttttacggtttcgg

SEQ ID NO: 349600 - DNA, 730 bp, Homo sapiens
  misc_feature: GZ8MTXP02IZYE2.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttctggctacaccttcaccggcgactatcctccacgtggggtcgcgtacgacggcccccgtaggaccgaaggggtcttggagtggatggggatggataccaaaccccctaaacgtaagtgggtacggacaaaccgaaactgtacgaccaacgaacggttaaagtttcggaaacggggtcgtaaacgggggttaccaaacccgtacgtacgggaacccgaacgggggtaacccaacccgggttaccccaacgttaccggaaacgacccgaaaaccgaaccgggtacccctttaaaccgaggttaccggggacgtacccggttaggaacgaccgtaacgaccgttaggaaaccctagtacccgtacggaaaccgaccgtaaccgggtacccttaaagtttttacttaaccgtggttaccggaacggtaaaggttcggtttacggtttaacccggggtggttccggtttcgggtttttaacccg

SEQ ID NO: 349601 - DNA, 702 bp, Homo sapiens
  misc_feature: GZ8MTXP02GKSZC.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggagggtgaggaagccgtgggcctcgagtgaaggtctcctgcaggtcttcgtggctaccacccttcgaccgggcgactactcctccgacgtgggtcgccgacgtaccggcccccgtagggaaccggtaacggggtccgttaggacgggtagggtaggtagggtagtacggaacttaacccgaaacccccgtaaaagaaggttcgggacggtaaccaaaaccgttaaacgttgtacgaccgtaaacgtaagttaacgttacgggacgggtacggtacggtacaccgtagtaccgaacggaggaccaccgtacactcgacgacaacgaccgtacctaacgtggtacggacgtacgaggacgacgaacgtacgacgtacgtacttaccggaacggtaaccgacggaacccggttacttaactttaccgtacggttcgtaccggtaaggtacggtttacgttaccgggtttacggtcggtttacggttttcggttttaccgg

SEQ ID NO: 349602 - DNA, 596 bp, Homo sapiens
  misc_feature: GZ8MTXP02HB0A9.45.37.D04.1.454.CMB.2.raw
  modified_base (245)..(245): a, c, t, g, unknown or other
  misc_feature (245)..(245): n is a, c, g, or t
  modified_base (322)..(322): a, c, t, g, unknown or other
  misc_feature (322)..(322): n is a, c, g, or t
  modified_base (334)..(334): a, c, t, g, unknown or other
  misc_feature (334)..(334): n is a, c, g, or t
  modified_base (438)..(438): a, c, t, g, unknown or other
  misc_feature (438)..(438): n is a, c, g, or t
  modified_base (482)..(482): a, c, t, g, unknown or other
  misc_feature (482)..(482): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccaacaagagcccactcccaggtgcagctggtgcagtcgtggggctgaggtgaggaagccgtggggccctagtagtaggacgtctcgngacgacgtctgcgactacctctaccgcggactactcgtcctactggtgcgacgacgccgtcgagaacgagtcgtagnggtagtggtagngagtacaacctaaacagtagtggacaacaaacgtaatagcgaccgaagtaaacgttacgtacgggcgagtacggaccaatcgacgacggtaggaacctcgaacncgacgacacacgactacataggagatcgaagcacgacagacacngtcgaacgacaacggtcaaactttagtttactaggtaccgtcggtaacggtaagttcggtttaaacgggtcggttaacggtttcggttttaccggtttttacggtaacccgggg

SEQ ID NO: 349603 - DNA, 598 bp, Homo sapiens
  misc_feature: GZ8MTXP02F26N2.45.37.D04.1.454.CMB.2.raw
  modified_base (288)..(288): a, c, t, g, unknown or other
  misc_feature (288)..(288): n is a, c, g, or t
  modified_base (342)..(342): a, c, t, g, unknown or other
  misc_feature (342)..(342): n is a, c, g, or t
  modified_base (362)..(362): a, c, t, g, unknown or other
  misc_feature (362)..(362): n is a, c, g, or t
  modified_base (441)..(441): a, c, t, g, unknown or other
  misc_feature (441)..(441): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctctgcaaggcttctggctacacttcaccggcgactatctccagtgggtncgacacggcccctggacagggcttgagtggatgggatggatcaaaccccttaanaagtggtgacaacgaaactntgacaacgaagtaagtttcgaggggtacaacggggtcaaccgaatacggaaccgaacggggaacctaccggtcctaaanacgacgacacgacgacctaacgacgtagggactacgtagacggacgaacgactagactacgtacgacggaccgaacgacggtaccttaatttacgttacgtgtacgtaacggtaggtacgtttacggtttacgggtcggttccggtttcggtttccg

SEQ ID NO: 349604 - DNA, 657 bp, Homo sapiens
  misc_feature: GZ8MTXP02JB4MN.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcgagtgaaggtctcctgcaggcttctggctacaccttcaccggcgactatctccacgtggtgcgacgacggccccgtggaccgaagggcttggacgtggagtgggatggataccgaaaccccctaacgaagtgggtacgacaacaaaactgtcgacaacgagtaacgtttcgacgggtcgaaggggtcaacccgagtacggacccgagggaccaccggtaccaatacgagccaaacgacgaccctaagacgtagggacgtacgtaggacgaccgaagtaacgtgaactacgttacgtacggaaccgaccgtaaccgggtaccttaaacgttttacgttaaccgttcggttaaggtaacccgggtaaaggttaacggtttcggggttttaacccggggtagggtttacccgttttacgggttttttacccgg

SEQ ID NO: 349605 - DNA, 603 bp, Homo sapiens
  misc_feature: GZ8MTXP02F61J3.45.37.D04.1.454.CMB.2.raw
  modified_base (222)..(222): a, c, t, g, unknown or other
  misc_feature (222)..(222): n is a, c, g, or t
  modified_base (290)..(290): a, c, t, g, unknown or other
  misc_feature (290)..(290): n is a, c, g, or t
  modified_base (431)..(431): a, c, t, g, unknown or other
  misc_feature (431)..(431): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcgtgggcctnagtgaggtctcctgcaaggtcttcgtggctacaccttcaccggcgactactctccacgtggtgcgacncggccccgtggacgaggtctgaggtgagtgggatggatcaaacctaaccgaagtggtacgacaacaaacgtagtgacataaggtaagtttacgaagggtcgagggtacacgagtacgacgacgggacacgtcacgtacganacgacgacgtacctaacgagtacggacgtacgtagacgacgagacgttacgacctagtaccgacggaaccgaccgtacggtacccttaagtttaacttaccgtaggtcggaaccggtaaggttacgttacggtttaccggtggtttccgtttcgggttttaccgtttacggg

SEQ ID NO: 349606 - DNA, 587 bp, Homo sapiens
  misc_feature: GZ8MTXP02FUWLR.45.37.D04.1.454.CMB.2.raw
  modified_base (385)..(385): a, c, t, g, unknown or other
  misc_feature (385)..(385): n is a, c, g, or t
  modified_base (441)..(441): a, c, t, g, unknown or other
  misc_feature (441)..(441): n is a, c, g, or t
  modified_base (458)..(458): a, c, t, g, unknown or other
  misc_feature (458)..(458): n is a, c, g, or t
  modified_base (474)..(474): a, c, t, g, unknown or other
  misc_feature (474)..(474): n is a, c, g, or t
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagcccactcccaggtgcagctggtgcagtcgtggggctgaggtgaggaagccgtggggcctcgagtgaaggtctcctgcaaggctctggctacaccttcaccggcgactatctccacgtggggtcgcgacgacggccccctaggacgaaggggtcttaggaggtgggagtggggatggactaccgaaaccctaaccgaagtggtaggacaacaaaactntgacaacgaagtaacgttcgagggcagggtcacgatcgaacgagggacacgtccanacagacacacgacctanagtgacgtcagacganaacgcgtagacaacgtcgacggaacgaccgacggtaccttaatttacgtacgttagtggtacgaaggttacttacgggtttacggtcggtacgtttcggtttacgttttacgg

SEQ ID NO: 349607 - DNA, 629 bp, Homo sapiens
  misc_feature: GZ8MTXP02JD2BM.45.37.D04.1.454.CMB.2.raw
  modified_base (250)..(250): a, c, t, g, unknown or other
  misc_feature (250)..(250): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaggtctctgcagcttngctacactcacggcactatctccagtggtgcgacacggcccctggacgaggtctggagtgggatggggatcggactaccaacccctaaagagtgggtagacaaacgtaaactgtacgacctaacgacgttaaagttcggaacggggtacgacggggtccaacccgtagtacggaaccgaggggacctaccggtaccaagtccgaacgaccgaacacggtaccctaaccgtagtacgggtaacgcgtaacggacgaccgtaacggtaccgtacggactacgtaccgtacggaaccgtacgaccgggttactaacgttttactacgttgtacggcgtaaggtacgttacgggttacggtcggtcgtttcggtttttaccgg

SEQ ID NO: 349608 - DNA, 631 bp, Homo sapiens
  misc_feature: GZ8MTXP02HV5HU.45.37.D04.1.454.CMB.2.raw
  modified_base (226)..(226): a, c, t, g, unknown or other
  misc_feature (226)..(226): n is a, c, g, or t
  modified_base (229)..(229): a, c, t, g, unknown or other
  misc_feature (229)..(229): n is a, c, g, or t
  modified_base (237)..(237): a, c, t, g, unknown or other
  misc_feature (237)..(237): n is a, c, g, or t
  modified_base (245)..(245): a, c, t, g, unknown or other
  misc_feature (245)..(245): n is a, c, g, or t
  modified_base (377)..(377): a, c, t, g, unknown or other
  misc_feature (377)..(377): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtctggggctggaggtgaggagcgtgggcctnagngagtctcngcagctgngtctacaccttcaccggctactactcctactacgtgggtcgcgacgaccggccccgtaggaaccgtaaggtcttaggaggtggagtgggataggatacccaaaccccgtaagacgtggacgacaaaccaaantgacaacgagttaagttcgaggtacgacggtacacgtagcgacgagggaccacgtcagacagcaagctacctacgagtaggacgcagacgacgaagtacgagtaactacgtaccgtacggaaccgtaacggaccgtactttaaacgtttacgttaaccggtcggttaggggaaccggttagggttaaaacggtttttccgggtttaaccggggttcggtttaacccgggtttttcggttttttaaccccggggg

SEQ ID NO: 349609 - DNA, 547 bp, Homo sapiens
  misc_feature: GZ8MTXP02HTKR3.45.37.D04.1.454.CMB.2.raw
  modified_base (370)..(370): a, c, t, g, unknown or other
  misc_feature (370)..(370): n is a, c, g, or t
  modified_base (447)..(447): a, c, t, g, unknown or other
  misc_feature (447)..(447): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgaactatctccactgggtgcgacaggccccctggacaaggcttgagtggatgggatggatacgaaaccccctaaacaaatgggtacggacaacaaaaactntagacaacagtaaagtttcaaggggcaagggtcaacctagagaccaagggacaacgtcaatcagcaacagccctaanagtggacgcgtagacgacagacagacactacgtacgacgacgacgactaacttacttacgtgtgaagagtacgttacgttacggtcggtcgttcgtttcg

SEQ ID NO: 349610 - DNA, 724 bp, Homo sapiens
  misc_feature: GZ8MTXP02J0PAN.45.37.D04.1.454.CMB.2.raw
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccgaggtgcagctggtgcagtcgtgggctggaggtgaggagccgtgggcctcgagtgagtctcngcagtctngctacnctcnccgnactctctcncgtggnccgacgaccggcccgtggacgaggtctaggaggtggagtgggatacggactaacctaaaccccgtaagagtgggtacgacaacgaaactgagacacgtagtaagttcgagggtacgtacggtaccaacgtacgtacgaacccggtagaccgtaccgtacctaagccgaacgacccaaacgtacccgtaaccctaaggtacggtacgggacgtaccgtaggaacccggaacgtaaccggttaaccgaacggtaacctaaccggtttacggtaaccggaaaacccgtaaaccccggtaacccgggtttaaaccctttaacggttttaaaccgttacggttaacgggttaccgggtaacgggtttaacggtttaaccgggttttacccggggtttttaccggggttaccggtttttcccgggtttttaccggggttttttaaccccgggg

SEQ ID NO: 349611 - DNA, 596 bp, Homo sapiens
  misc_feature: GZ8MTXP02IDW8N.45.37.D04.1.454.CMB.2.raw
  modified_base (226)..(226): a, c, t, g, unknown or other
  misc_feature (226)..(226): n is a, c, g, or t
  modified_base (350)..(350): a, c, t, g, unknown or other
  misc_feature (350)..(350): n is a, c, g, or t
  modified_base (437)..(437): a, c, t, g, unknown or other
  misc_feature (437)..(437): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtgggcctnagtgaggtctctgcgaggcttcgtggctacaccttcaccggcgactatcctccacgtggggtgcgacgacggcccccgtggaacaagggtcttggagtggagtgggatggactcaacccctaanagtggtacggacaacaactgtgacagtagaacgtttcgagggcgacgggtcacagtcgacgaggacacgtacacgtacacgcgaacnccgaccacgtagtaggacgtacgtagacggcaacggtacgtacaacagtccgtacgaacggaccaaccggtaccttaagttttacgttaaacgtggttagtaaggaacggttaggtttacggtttacggggtcggtttcgtttaccgggttttttccgg

SEQ ID NO: 349612 - DNA, 612 bp, Homo sapiens
  misc_feature: GZ8MTXP02F59ZA.45.37.D04.1.454.CMB.2.raw
  modified_base (257)..(257): a, c, t, g, unknown or other
  misc_feature (257)..(257): n is a, c, g, or t
  modified_base (296)..(296): a, c, t, g, unknown or other
  misc_feature (296)..(296): n is a, c, g, or t
  modified_base (391)..(391): a, c, t, g, unknown or other
  misc_feature (391)..(391): n is a, c, g, or t
  modified_base (483)..(483): a, c, t, g, unknown or other
  misc_feature (483)..(483): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtgggcctcgagtgaaggtctcgtgcaaggcttcgnggctacaccttcgaccggcgactactctccagtgggtcncgacacggccccgtaggaacgaagggtcttaggaggtggagtggggatggactaccccgaaaccctaacgaagtcgggtacgaccaaacgaactntacgacacgtagtaagtttcgagggcgtaggtaccacgagacgaaccgaggaccacgtccaatcgacgcaacgacgaccctagagtaggganaccgtgaagcgaagacgtacgactacgttcgacgaacgaccgaccggtaccttaagttttacgtacgttggtaacgtacggtaacggtacgtttacgggtttaccgggtcggtttcggtttttaccggg

SEQ ID NO: 349613 - DNA, 607 bp, Homo sapiens
  misc_feature: GZ8MTXP02HCSE0.45.37.D04.1.454.CMB.2.raw
  modified_base (224)..(224): a, c, t, g, unknown or other
  misc_feature (224)..(224): n is a, c, g, or t
  modified_base (366)..(366): a, c, t, g, unknown or other
  misc_feature (366)..(366): n is a, c, g, or t
  modified_base (473)..(473): a, c, t, g, unknown or other
  misc_feature (473)..(473): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtcgtgggctgaggtgaggagcctgggctnagtgagtctcctgcaggctctggctacaccttcaccggcgactatcctccacgtggtgcgacgacggccccgtggacaagggcttagaggtggagtgggataggataccaaaccccctaacaagtcggtagacaacaaactntagacaacagtaagttcgagggcgacggtcaacccgagtcgaccgagggacacgtaccatcagcaacacgacctagacgtggacgcgtacgaagccgaagtaaccgngaactacgtaccgaacggaaccgtaaccgaaccgggtaccttaaagttttactaaccgttggtaccggtaaggtaacggggttagttaccgggttttaacgggtcgggttaccgttttacgggttttttcccgg

SEQ ID NO: 349614 - DNA, 598 bp, Homo sapiens
  misc_feature: GZ8MTXP02IUZN9.45.37.D04.1.454.CMB.2.raw
  modified_base (245)..(245): a, c, t, g, unknown or other
  misc_feature (245)..(245): n is a, c, g, or t
  modified_base (286)..(286): a, c, t, g, unknown or other
  misc_feature (286)..(286): n is a, c, g, or t
  modified_base (447)..(447): a, c, t, g, unknown or other
  misc_feature (447)..(447): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcgtgggcctgagtgaggtctctgcagctntgctacaccttcaccgcgactatcctccacgtggtgcgacncggccctaggacgaaggcttgaggtggagtgggatggactacccaaaccctaacgaagtgggtagaccgaacaactagtacgacacgtaaggtagtttacgagggacgtacgggtacaaccgagtacggaaccgaacggggaacctaccgtaccgtaaacncgaaacgaccgaaacgaccggtacccctaacgtagtacgggagtaccgtaggaacgacgaacggactacggacacgttacgacgacgaaccgacggtacctagtttacgtcgtgcgacgacgtacgttcggtttacggtcgttcgtttcgg

SEQ ID NO: 349615 - DNA, 755 bp, Homo sapiens
  misc_feature: GZ8MTXP02H8YAN.45.37.D04.1.454.CMB.2.raw
tcagacgcgatcgacacgaccggtgctcgatttagtagcatactgttgggtttgggggagcatcacccagcaaccacatctgtcctctagagaatccccctgagagctccgttcctcaccatggactggacctggaggatcctctttcttggtggcagcagccacaagacgcccactcccaggtgcagctggtgcagtcgtgggctgaggtgaggaagcgtgggcctcgaggtgaggtctccgtgacgaaggtcttctcggctacctacccttcgaccggacgactactctccacgtgggtgaccgaccggacggcccccgtaggaacgaacggggtcttaggaggtagggtagtgggatagggtacctacctaaaccccccgtaaagtaacgtggtacggacaaaccgtaaaccgttagtacgggacctaaagtaacgggttaaacggtttaccggggacggtaacgtacgggggttaccaaaccggtaagtaaccggaaaccggaaaccgggtacgaccggttaaccacgtaaccgacggaccaaacgtacggaaacccttacgtaagtagggaacgtccggtaagaacgacgttacgaacggttacaacccgtagttacgtaccggaaccggttcccaaacgggtttacccttaaatttttaacgtaaccgtttgtaaccggtaaccgggtaggttaaccggtttcggggtttacccggtggtttcggtttttaccggtttttaacccgggg

SEQ ID NO: 349616 - DNA, 644 bp, Homo sapiens
  misc_feature: GZ8MTXP02J0FRO.45.37.D04.1.454.CMB.2.raw
  modified_base (508)..(508): a, c, t, g, unknown or other
  misc_feature (508)..(508): n is a, c, g, or t
  modified_base (522)..(522): a, c, t, g, unknown or other
  misc_feature (522)..(522): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttctggctacaccttcgaccggcgtactatctccgtacgtgggtgcgaccgacggcccccgtaggaacgtaacggggtcttacggaggttggagtgggaagtggacttaccgaaaccccctaagaagttcgggtaggactaaaccgaaacttagcgaacgaccgtaagtaaaacgtttcgaacgggggcgtaacggggttaccaaaccagtacggaacccgagggaccaccgtcgaatcgacgacacgtagaccctaagngtagggagtaccgnggacacgacgtacgtgacaacgttcgtacggaaccgacggacccgacctttatttacgttaccgtggtacgaacgtaacggtcgtttacgggttaccggtggttccgtttcggttttcccgg

SEQ ID NO: 349617 - DNA, 658 bp, Homo sapiens
  misc_feature: GZ8MTXP02H3G3I.45.37.D04.1.454.CMB.2.raw
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
  modified_base (338)..(338): a, c, t, g, unknown or other
  misc_feature (338)..(338): n is a, c, g, or t
  modified_base (479)..(479): a, c, t, g, unknown or other
  misc_feature (479)..(479): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagcccaacaagacgcccactcccgaggtgcagctggtgcaggtcgtggggctggaggtggaaggacgcgtcgggctcgagtgacgtctcngacgagtctcgnggctacctccttcgaccggcactactcctccacggtggtgccgacgaccggccccgtaggacgaggtctaggaggtggngtgggatcggaactacccaaaccccctaagacgttgggcgacaaactaaacgtgtcgacaacggtaaagttaacggttcgaacggggtacgaacgggtaccacgtagaccggaaccggacggggaaacctaccggacctanaccggacgacctaacaccggtaccctaatagggtagaacgcggtagaacggacctaggaaccgtagaactacgttacggacgaaaccggtaccgtaaccggtacttaattttacgtctacggttaggaaccgtaggtacgtttacgggtttcggtcggtttcgtttacggtttttccgg

SEQ ID NO: 349618 - DNA, 625 bp, Homo sapiens
  misc_feature: GZ8MTXP02J1WZ3.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaacgccgtggggcctcgagtgaggtctctgcagcttcgtggcctacaccttcgaccggcactactcctcctacgtgggtcgccgacgacggtccccgtaggaccgaagggtcttggaggtggagtgggatcggactaccgaaacccctaacgtagtcgggtacgacaacaaactgtacgaccgaacgtagtaacggttcgaacgggtcgaacggtaccaactacgtacgaaccggacgggtaccacgtaccaactaccgaaacacgacgtacctaagagtgacgcgtagacacgaagactacgactacgtacgacgaaccacgtaccgactttaatttacgtacgtcgtacgacggtaagttacgttacgggttaccggtggtttcgtttacgggttttcgtttaacggg

SEQ ID NO: 349619 - DNA, 626 bp, Homo sapiens
  misc_feature: GZ8MTXP02JA2RD.45.37.D04.1.454.CMB.2.raw
  modified_base (508)..(508): a, c, t, g, unknown or other
  misc_feature (508)..(508): n is a, c, g, or t
  modified_base (518)..(518): a, c, t, g, unknown or other
  misc_feature (518)..(518): n is a, c, g, or t
  modified_base (533)..(533): a, c, t, g, unknown or other
  misc_feature (533)..(533): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagcgtgggcctcgagtgaggtctcgtgcgaaggtcttcgtcggtctaccgtaccttccgaccggcgactactcctaccagtgggtcgcgacgaccggcccctaggaacgagggctttggaggtggagtgggagtgggatacccctaaaccctaacgaagtgggtacggaaccaacaaacctgtacggtaccaaagtaagtaacggtttaccggaaagggtaccgtaacggggtaccaccgtacgtacggaaccgaggggtaaccacgtacatacgacacacaccgactacgngaggaccgtnagcgacgagacgtanactagcgtaacggagtaaccggataccttagttaacgttcgtagtcggaggtaacgttacgttacgggttacggtcgttcggtttttacccgg

SEQ ID NO: 349620 - DNA, 600 bp, Homo sapiens
  misc_feature: GZ8MTXP02HW0K0.45.37.D04.1.454.CMB.2.raw
  modified_base (259)..(259): a, c, t, g, unknown or other
  misc_feature (259)..(259): n is a, c, g, or t
  modified_base (335)..(335): a, c, t, g, unknown or other
  misc_feature (335)..(335): n is a, c, g, or t
  modified_base (451)..(451): a, c, t, g, unknown or other
  misc_feature (451)..(451): n is a, c, g, or t
  modified_base (465)..(465): a, c, t, g, unknown or other
  misc_feature (465)..(465): n is a, c, g, or t
  modified_base (510)..(510): a, c, t, g, unknown or other
  misc_feature (510)..(510): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgagacgggccacatcaactgacaacgtccagccagtagttgtttagacagcctaccaaanaaataaagaactacttagcttacggtaccagcaaacgaaaccaggtcacgcctaccaagctcgctactatttacgnggtacacgtacccgtaacccgggacgtcccggggtcccctacgaccgtatccgaggtcggcacggggtccggtcgtagggacctaggttacttcgtacctctaccacctatccgancgtacgcctgacgngctagaagcgtggcgtattagtttgcgtcgtgacagtactaattnttattaacttctccttcgtacttccggaccgtacggtaacctaaaggtcgtaattaacgaaacgtacctaaagtcggtacggtctaaccg

SEQ ID NO: 349621 - DNA, 618 bp, Homo sapiens
  misc_feature: GZ8MTXP02GU5FP.45.37.D04.1.454.CMB.2.raw
  modified_base (284)..(284): a, c, t, g, unknown or other
  misc_feature (284)..(284): n is a, c, g, or t
  modified_base (386)..(386): a, c, t, g, unknown or other
  misc_feature (386)..(386): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccagggtgcagctggtgcagtcgtggggctggaggtgaggagccgtgggcctgagtgaggtctcctgcgaaggcttcgtggctacaccttcaccggcgactactccncctacgtgggtcgcgacgacggccccgtggacgaagggtctggagtgggagtggggatggactaccccgaaacctaacgagtggtacggacaaacaacgttngaccaaacgaaggtaacgtttaccgaggggaccgaacggggtacaacgagtacgaaccgacggaccacgtaccagtaccacgacaacacggtacctacgaggtacggaagccgtagacggacaagtacagacactacgacgaaccggacaaccggtcttaacgttaacgtaccgttgaacggtacggtacggtaacggtttcggtttaccggtcggttaccggtttttcggg

SEQ ID NO: 349622 - DNA, 708 bp, Homo sapiens
  misc_feature: GZ8MTXP02HCMCJ.45.37.D04.1.454.CMB.2.raw
  modified_base (407)..(407): a, c, t, g, unknown or other
  misc_feature (407)..(407): n is a, c, g, or t
  modified_base (540)..(540): a, c, t, g, unknown or other
  misc_feature (540)..(540): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccacctcccaggtgcagctggtgcagtcgtggggctggaggtggaggaagccgtggggcctcgaggtagaaggtctcctgcgaaggtcttcgtggcctacacccttccgaccgggccgactactcctacccacgtgggtcgcgacgaccggccccgtggaacgaaggtcgttggaggtggaggtgggataggactaccaaaacccctaacgaaagtgggtacggacaaacgtaaactntacgacaacgaagtaacgtttacggacgggtcgaacgggtaccaacctagacggaaccggaaggggacctaacccgtactaacgaccgacggacaaaccgacgtacccgttaacgagggtacggacgtaccgnggaaacgacgaacggtactacggaactcttaccgtacggaaaacccgaccggtaaccggtaccttttaaagtttaacgttaacccgtggttacgggccggttaaaagggtgtttttaaccccgggggtacgtttcgggtacccgtttttcggggttttttaaccccgg

SEQ ID NO: 349623 - DNA, 581 bp, Homo sapiens
  misc_feature: GZ8MTXP02GD2LY.45.37.D04.1.454.CMB.2.raw
  modified_base (320)..(320): a, c, t, g, unknown or other
  misc_feature (320)..(320): n is a, c, g, or t
  modified_base (381)..(381): a, c, t, g, unknown or other
  misc_feature (381)..(381): n is a, c, g, or t
  modified_base (416)..(416): a, c, t, g, unknown or other
  misc_feature (416)..(416): n is a, c, g, or t
  modified_base (443)..(443): a, c, t, g, unknown or other
  misc_feature (443)..(443): n is a, c, g, or t
  modified_base (471)..(471): a, c, t, g, unknown or other
  misc_feature (471)..(471): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagtccgtttagacagctaccaaacaataagaactactagcttaggtaccagcaagaaccaggtcagcctactaagctgctctatttacgnggactactccgtacccgggaacgtcccggggtaccccctaggaccgtattcgaggtcgcgngggcgggtctgggatagtactttcactctccaccntcagcacgctgccgaggctaggaaagngtggtggcttagtttacgtgcgttgtanagtacttaattatttattacttacctttccgtaccgttaccgttccggaccgttacggaaccgtaaggttacgtaataacgtaaacgtaacgtagtacggtacgtactcg

SEQ ID NO: 349624 - DNA, 615 bp, Homo sapiens
  misc_feature: GZ8MTXP02IEB48.45.37.D04.1.454.CMB.2.raw
  modified_base (377)..(377): a, c, t, g, unknown or other
  misc_feature (377)..(377): n is a, c, g, or t
  modified_base (495)..(495): a, c, t, g, unknown or other
  misc_feature (495)..(495): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtggaaggtctcctgcaaggcttctggctacaccttcaccggcgactatcctccacgtgggtcgcgacgacggcccccgtggaccgaaggggcttggaggtggagtgggatggatcccaaaccctaacagtggtcgacgacaacgtntgcacagtaagtttcgagggacgagggtaccacgtagtacgaacccgaggggaccaaccggtacccaataccgacgaccaaccgtacgacccgttacgaacgtggaacgcctaggacncgaacggtacacgaactacgtcgtacgaccggacaaccggtactttaacgttacgttaacgtcggtcggtaccggtaggtacgtttcggtttaacccggttggtttccgtttttaccggg

SEQ ID NO: 349625 - DNA, 679 bp, Homo sapiens
  misc_feature: GZ8MTXP02GCOWY.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtgggcctcgagtgaaggtctcctgcgagtcttcgtggctaccaccttccgaccggcgactatcctcctagtgggtgcgacgaccggcccccgtggaacgaacgggtcttggaggtggagtggggatggtactaccaaacccccgtaaagagtgggtaggacaaaccgaaacttgagacaacgtaaggtaacgtttacggaaggggactacggggtaccaaccgagtacggaaccgaagggaccacgtccaagtcagaccacacggacctaacgagtagggacgaccgtagacggacctaacggaccgtaggaacctacgttaccgtacgggaaaccgacccgaaccggttaccctttaaagttttacgttaaccgttggtaacgggtaaccggtaagggttacgttttaccggggtttacccgggttcggtttaccgggttttcgggttttttaacccggg

SEQ ID NO: 349626 - DNA, 763 bp, Homo sapiens
  misc_feature: GZ8MTXP02H8UJP.45.37.D04.1.454.CMB.2.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagacgcccactcccaggtgcagctggtgcagtcgtgggctggaggtgaggagcgtgggcctnagtgagtctcgtgacgagtctcgnggactaccaccgttcgacccggcgtactactcctccgtacgtggggtcgccgaaccgccggtcccccgtagggaaccgtacgggtcttaggagggtaggtagtggggagtagggaacctaaccgtaaaaccccctaaacgtaaaggttcggggtacggaacctaaaacgtaaacgtagtacgaactaaacgtaaaggttaaacgtttcgggaagggtaccgtaacggggtacccaaacggacgtaaccggaaacccggacgggtaaacccgtaaccggtaccaaacgtaccggacaaaccgaaaccgtaccgaacccgttaagaagggtcggaaccggtacgtaaacggacgacgtaaacgtacgtaacgaaccgtacgtaccggtaacggaaaccggtaccgtaaacgttaaccgtttaacgtttaccgttacggtacgtacgggtaacggttaacggttacggtttaccggggtttacggttacggtttccggtttttaccggtttacgg

SEQ ID NO: 349627 - DNA, 665 bp, Homo sapiens
  misc_feature: GZ8MTXP02GBE7Q.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtgggcctcagtgaaggtctcctgcaaggcttctggctacaccttcgaccggcgactatcctccacgtgggtcgcgaccgacgggccccctagggaaccgaaggggtcttaggaggtgggaagttggggaatggaactaccaaaccccctaaagaagtgggtacggaccaaacaaaactgtcgaactaacgaagttaacggtttacggaggggaccgtacggggtacaacccgagtacggaaccgaacggggaccaccggtaccaagtcaacgacaaacgacgtacctacgaagtcgggaacgtacgagaacgaccgagtaacgtagaaccgtattcgtaacggaaacccgaccggtacggtaccttaagttttacccgtaacgtggtacgaacggtaggttaacgtttcggggttacccggtggtccggttttacggttttacccgg

SEQ ID NO: 349628 - DNA, 625 bp, Homo sapiens
  misc_feature: GZ8MTXP02HS71G.45.37.D04.1.454.CMB.2.raw
  modified_base (394)..(394): a, c, t, g, unknown or other
  misc_feature (394)..(394): n is a, c, g, or t
  modified_base (469)..(469): a, c, t, g, unknown or other
  misc_feature (469)..(469): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctctttcttggtggcagcagccaacaagacgcccactcccaggtgcagctggtgcagtcgtggggctggaggtgaggaagccgtggggcctcgaggtgaaggtctccgtgcgaaggtcttcgtggcctacacccttccgaccggccgactactcctccacgtgggtgccgacgacggccccgtaggacgaagggtcttggaggtgggagtggggataggactacaaaccccctaagaagtggtgacaacaaatntgacacgagtagttcgaggcgagtcacgatacgacgtaacgggacacgtcaagtcacgacaacgcgacctaacgngtacggagctaggacgacgagacgtacgactacgtacgtacggaaccggtaacgaccgtacgttaaactttacgttaaccgtggttacggaacggttaagggtacgtttaccggggtttaaccggtcggttaccggtttttacggtttttacccgg

SEQ ID NO: 349629 - DNA, 692 bp, Homo sapiens
  misc_feature: GZ8MTXP02JLH40.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggagatcctcttcttggtggcagcagccaacaagacgcccactcccaggtgcagctggtgcagtcgtgggctggaggtgaggagccgtgggcctcgagtgaggtctcgtgcgaagtcttcgtggcctactccttcgaccggcgtactactcctaccacgtgggtcgccgacgaccggccccgtaggaacgaacgggtcttaggacgtggtagtgggaacgtggaactaccgtaacccctaaagtaagtcggtacggtaccaaacttaaaactgtacgactaaaccgtaagtaacggtttcgaggggtaccgtacggggtaaccaaccgtagaacggaaccgacggggaacctacccgacgtaactaccgacgacgaaaccgacgacccgttaacgagtacggacggtaccgaggaacgacgaacggtactagaacctagttacgaaccggaacgacccgaacggtaccttaaaccgttttagtaaccggttggtacgtaacggtacgtaacggtttacggggttaaccggtcggttacggttttccggtttttaaacccgg

SEQ ID NO: 349630 - DNA, 620 bp, Homo sapiens
  misc_feature: GZ8MTXP02F1YI0.45.37.D04.1.454.CMB.2.raw
  modified_base (251)..(251): a, c, t, g, unknown or other
  misc_feature (251)..(251): n is a, c, g, or t
  modified_base (258)..(258): a, c, t, g, unknown or other
  misc_feature (258)..(258): n is a, c, g, or t
  modified_base (343)..(343): a, c, t, g, unknown or other
  misc_feature (343)..(343): n is a, c, g, or t
  modified_base (364)..(364): a, c, t, g, unknown or other
  misc_feature (364)..(364): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctggaggtgaggaagcctggggcctcagtgaaggtctcctgcagcttcnggctacnctcaccggcactatcctccacgtggtcgcgacacggcccctggacgaaggcttggagtggatgggatggtactcaaacccctaanagtcggtacgacaacaaactntcgacaagagtaagttcgaaacggggcaagggtccaacgagtacgaacccggaacgggacaccgtccaatccgaacgcaacgacgccgtaacgtaagtggaacgctaggacggctaagaccgtagactacgtccgtacgaacggacccgtaaccggtacttaaacgttttaacgttacgtgggttacgtaacgggtaacggttacgtttacggggtttacccgggttgggttacccgtttcggggtttttacccgg

SEQ ID NO: 349631 - DNA, 633 bp, Homo sapiens
  misc_feature: GZ8MTXP02GGML4.45.37.D04.1.454.CMB.2.raw
  modified_base (236)..(236): a, c, t, g, unknown or other
  misc_feature (236)..(236): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctggaggtgaggagcgtgggctgagtgagtctcngcaggtcttcgtggctactaccttcgaccggcgtactactcctccgacgtgggtgccgacgaccggtccccgtaggacgaagggtcttaggagtggagtgggatggactaccaaccccgtaagagtggtacgacaaactaacgtgtacgacaacgtaagtaacgttcggacgggtcgtaacgggtcaaccgtagtaccgaacggacgggaccaccggtacctaacgcgacgaccaaccgtacgaccctaaggtacgtacgggacgacgtacgacggacgaacgacgtacgactacgtctacggaaccgtaccgaccggtaccttaagtttacgtacgtcgtacggtaacggtacgtacggtttacggttacggtcgttacggtttcggttttaccgg

SEQ ID NO: 349632 - DNA, 540 bp, Homo sapiens
  misc_feature: GZ8MTXP02I1YIU.45.37.D04.1.454.CMB.2.raw
  modified_base (341)..(341): a, c, t, g, unknown or other
  misc_feature (341)..(341): n is a, c, g, or t
  modified_base (358)..(358): a, c, t, g, unknown or other
  misc_feature (358)..(358): n is a, c, g, or t
  modified_base (415)..(415): a, c, t, g, unknown or other
  misc_feature (415)..(415): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagccgtggggcctcagtgaggtctcctgcaggcttctggctacaccttcgaccggcgactatctccacgtgggtgcgacacggcccctggacaagggcttgagtggatgggatggatcaacccctanagtggtgacacaaactntcgacacagagtttcgagggcgagggtcacgatagaccgaggacacgtcatcagcanacgctacgatggagtctagagacagacgtgacatacgtagaccgacgaccggtactacgtttactaccgtgtacgcggtaggtacgttacggtttacgggtcggttacgtttcggtttttaccgg

SEQ ID NO: 349633 - DNA, 710 bp, Homo sapiens
  misc_feature: GZ8MTXP02JMENB.45.37.D04.1.454.CMB.2.raw
  modified_base (251)..(251): a, c, t, g, unknown or other
  misc_feature (251)..(251): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctgaggtgaggagccgtggggcctcgagtgaggtctcctgcaaggcttcnggctacaccttcgaccggcgactatcctccgtacgtgggtcgccgacgaccggcccccgtagggaaccgaaggggtcttaggaggttgggaagtgggagtggaactaccaaacccccgtaacaagtggtacggacaacgaaactgtacgacaacgtaggtaacgtttcggaacgggtcgtaacgggggtccaaaccgtagacggaaacccgaagggggtaccaaccggttaccaacgtaccgaggacccaacgaaccggtaccctaaaccgtaggtacgggaacggttcccgtaaggggacgacgtaaacgaccgtaggaactactaccggtaacggaacccggacgtaacccggacctttaagttttacctaaccggttggtacgtaacggggtacgttaaacggtttccggggtttacccgggtaggtttaccgtttttcgggtttttaacccccgg

SEQ ID NO: 349634 - DNA, 690 bp, Homo sapiens
  misc_feature: GZ8MTXP02HVC8F.45.37.D04.1.454.CMB.2.raw
tcagacgcgatcgacacgaccggtgctcgatttagtagcatactgttgggtttgggggagagcatcacccagcaaccacatctgtcctctagagaatccccctgagagctccgttcctcaccatggactggacctggaggatcctcttcttggtggcagcagccacaagagcccactcccaggtgcagctggtgcagtcgtggggctggaggtgaggagccgtgggcctgagtgaggtctccgtgcaaggcttctggctacctaccttcgacccggcgactatcctaccacgttggggcgaccgacgaccggtcccccgtaggaacgaaggggtctttaggaggtggagtggggattggactacccgaaacctaacgagtgggtcgaccaactaacgtgtacgacacgtaagttaacgtttacggaacggggtcgtaacggggtaccaaacgtaggtaaccggaacccgtaaacggggaaccctaaccggttacccaacgtacgaacggaccaaccgacggtaaccccttaacgacggttagggacgtaccgtaggacgacgaacgtacgtacggaactacgtacgtacggaaccgacgtaccggtaccttatttaaacgttccgtagtaaccggtacggtaaggttacgtttaccgggtttacgggtcggtttacggttttttcccggg

SEQ ID NO: 349635 - DNA, 629 bp, Homo sapiens
  misc_feature: GZ8MTXP02G5618.45.37.D04.1.454.CMB.2.raw
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaaggtctcgtgcaggtcttcnggctacnccttcaccggcgactactcctccacgtgggtcgcgacgacggcccctaggacgagggtcttggagtggagtgggatggactacaaaccccctaagagtgggtcgacaaactaaactgtcgacacaagtagttcgagggacgacgggtcacgagcgacgaggacacgcatcgacgcaacgacgactacgagtagggacacgtagacgtacgaacgacgtagaacctagttaccgtaacgaacccggaccgaaccgggttacccttaaagtttttacgttaccgttaggttccggaagggttaacggttacggtttacggggttttacccgggtacgggtttacccggtttcgggttttttaaccccggg

SEQ ID NO: 349636 - DNA, 512 bp, Homo sapiens
  misc_feature: GZ8MTXP02ISY9W.45.37.D04.1.454.CMB.2.raw
  modified_base (351)..(351): a, c, t, g, unknown or other
  misc_feature (351)..(351): n is a, c, g, or t
  modified_base (430)..(430): a, c, t, g, unknown or other
  misc_feature (430)..(430): n is a, c, g, or t
  modified_base (481)..(481): a, c, t, g, unknown or other
  misc_feature (481)..(481): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtctgggctgaggtgagagcctggggctcagtgaggtctcctgcaaggcttctggctacaccttcaccggcgactatctccactgggtgcgacaggcccctggacaaggctgagtggatggggatggatcaacccctaacataggtggcaacaaactntagctaacagaagtttcaggggtcagggtcacagtcgaccagggacacgtaccatcacgctacacgcctacatcgggancgtgagcagatgacattcgagacgacacgcctagtttactactgtgaacgngagttacgttaccggtggtctttggtttccg

SEQ ID NO: 349637 - DNA, 791 bp, Homo sapiens
  misc_feature: GZ8MTXP02IGW86.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgaccagtctccagacctcctggctgtgtctcgtgggcgagacgggccaccatcaactgacaagtccagccagtagttgtttagacagtcctacaaacaaataaacgaacttactacgcgttacggtaacccagacaaacgaaaccgtaggtaccgaacgtcccctaaccgtaaagccgtacgaccttacttaacgttttaacgccgggtactaaccgtacccggtaaaccccgggtaccggtccccggggtacccccctacggtaaccgtactttaccgaggttcgggaccgtcgggtccggggttcgtaacggggacttaacgttactttaacccaccgttacccttaccgaaaacccttgtaccccgaaaggcccgtacccgggtccttacgggaccccgtaagggtacccgtaaaggggtaaaactgggtttaaccgggtagggtttaacgtttagggttttaactcggtccgttagtaaccgtagtaaactttaatttacttaaaagtttaccttccggtttaccctttaaccggtacgttttaccccggaccggttaaacggtaaaaccaaggttacgtaaactacgtaaaacccggtaaagttaacgtccggaaggtttccgaacc

SEQ ID NO: 349638 - DNA, 698 bp, Homo sapiens
  misc_feature: GZ8MTXP02JNBVS.45.37.D04.1.454.CMB.2.raw
  modified_base (250)..(250): a, c, t, g, unknown or other
  misc_feature (250)..(250): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctctgcaggcttcnggctacaccttcaccggcgactatctccacgtgggtgcgacacggcccctggacgaagggcttggagtggatgggagtggactacaaacccccgtaacaagtggtacggacaacgaaaactgtacgacaacgtaagtaaagtttaccgaggggtacgaacgggggtaccaaacccgtagtacggaacccgaagggggaaccctaaccggtacccaacgtaccgaacggaccaaacgaacggacccttaaacgagtacgggacgtaccgtaggacgacccgaagaaccgtacggaaacgtacttaccgtaacggaaccggaaaccgaccccggggtaccttaaagtttttaacgttaaccgttagggtttacggaaccggtaagggttaacgtttaccggggtttaaccggggtttcggtttaccggttttcgggttttttaccccggg

SEQ ID NO: 349639 - DNA, 665 bp, Homo sapiens
  misc_feature: GZ8MTXP02GPRZB.45.37.D04.1.454.CMB.2.raw
  modified_base (257)..(257): a, c, t, g, unknown or other
  misc_feature (257)..(257): n is a, c, g, or t
  modified_base (467)..(467): a, c, t, g, unknown or other
  misc_feature (467)..(467): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagacgcccactcccaggtgcagctggtgcagtcgtgggctggaggtgaggacgccgtgggcctcgagtgacggtctccgtgacgagcttcgnggctactacctcgaccggcgactatcctaccgacgtggtcgccgacgccggcccccgtggaacgaagggtcttaggaggtggagtgggataggactaccaaacccctaacgagtgggtacggacaaacaaactgtcgacgaacgtaagttaacgtttggaacgggtacgaagggtaccaacgtagaccggaaccgaggacccacgtcaancgacgactacacgccctaagagacggacgacctagaacgacgaacgtaacgttacggaactacgttacgtacggaaaccgaaccggtaccggttaaccctttaaattttacgttaacgtcggtacggtaacgggtacggtaacggttttacgggtttacccgggtcggtttccggtttttacggtttttaacccgggg

SEQ ID NO: 349640 - DNA, 606 bp, Homo sapiens
  misc_feature: GZ8MTXP02G4B99.45.37.D04.1.454.CMB.2.raw
  modified_base (254)..(254): a, c, t, g, unknown or other
  misc_feature (254)..(254): n is a, c, g, or t
  modified_base (392)..(392): a, c, t, g, unknown or other
  misc_feature (392)..(392): n is a, c, g, or t
tcagacgcgatcgacacgaccggtgctcgatttagtagcatactgttgggtttggggagcatcacccagcaaccatatctgtcctctagagaatcccctgagagctccgttcctcaccatggactggacctggaggatcctcttcttggtggcagcagccacaagacgcccactcccaggtgcagctggtgcagtcgtggggctggaggtgaggacgccgtgggcctcagtgaaggtctctgcaaggtcttcgnggctactaccttcgaccggacactatcctaccacgtgggtcgccgtacgaccgggccccgtagggaaccgaaggggtcttggaggtggagtgggactggactaccaaacccctaagaagtggacggactaacgaactntcgacacgtagtagttcgagggcgaggtcaacgagtcgaaccgaggacaccgtacacgtcgacgaccaaacgcgaccctagagttcggaagcgtacggacacgaagaccttaggaactacttacgaacgaccgaaacgcgtaaacctattttacgtacgtgtacgaacggtaagttacgttcggtttacggtcgttacgtttcggtttttaccg

SEQ ID NO: 349641 - DNA, 556 bp, Homo sapiens
  misc_feature: GZ8MTXP02H1GQ1.45.37.D04.1.454.CMB.2.raw
  modified_base (238)..(238): a, c, t, g, unknown or other
  misc_feature (238)..(238): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
  modified_base (387)..(387): a, c, t, g, unknown or other
  misc_feature (387)..(387): n is a, c, g, or t
  modified_base (399)..(399): a, c, t, g, unknown or other
  misc_feature (399)..(399): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
tcagacgcgatcgacacgaccggtgctcgatttagtagcatactgttgggtttggggagcatcacccagcaaccacatctgtcctctagagaatccccctgagagctccgttcctcaccatggactggacctggaggatcctctttcttggtggcagcagccacaagacgcccactcccaggtgcagctggtgcagtcgtgggctggaggtgaggagcgtgggcctgagtgagctccngnagtctngcacncctncgnantcncagnggncgacgcgccngganaggctgagtgagtggatggatccaaaccccanagtggtacacaataacntcgacacgtagtaacgttcggagtacgaggtacacgtancggaaccgnggaacncgtacacaacgngaacaacgacaccagagagcgagngaaccgntacgcacgactacgacgtacggaccgacggaaccgttaccgttaaactttacgtaacgttggacggtaaccgtaggtacgttttaaaccggtacgggttcgttcggtttttacgttttaacccggg

SEQ ID NO: 349642 - DNA, 702 bp, Homo sapiens
  misc_feature: GZ8MTXP02G9FPZ.45.37.D04.1.454.CMB.2.raw
  modified_base (255)..(255): a, c, t, g, unknown or other
  misc_feature (255)..(255): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaagccgtggggcctcgagtgaggtctctgcaggcttcnggctacacctcaccggcgactctctccagtgggtgcgacgcggcccctaggacgaagggtcttaggagttggagtcggggatcgggaactccccccgaaaaccctaagtaacggtcggggtaacggaccaaaaccgaaccgttagaccggactaaaccgtaaagggttaaacgtttacgggaacgggggtaacgtacggggttacccaacgtaacgtaccggaaacccgggaagggaaccctaccggtacctacgacgacgaccaacgaccgtaacctaacgagggttacgggaacgttacgacgggaacgacgacgtaaacgtcgtaaacccagttacccggttaacggaaaccggaacccgtaaccgggtacctttaaggtttacttaacggtaggtccggtaacgtaggtcgtttaacgggtttccggcgttacggttttccgg

SEQ ID NO: 349643 - DNA, 597 bp, Homo sapiens
  misc_feature: GZ8MTXP02IAU0I.45.37.D04.1.454.CMB.2.raw
  modified_base (274)..(274): a, c, t, g, unknown or other
  misc_feature (274)..(274): n is a, c, g, or t
  modified_base (434)..(434): a, c, t, g, unknown or other
  misc_feature (434)..(434): n is a, c, g, or t
  modified_base (462)..(462): a, c, t, g, unknown or other
  misc_feature (462)..(462): n is a, c, g, or t
tcagacgcgatcgacacgaccggtgctcgatttagtagcatactgttgggtttggggagcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcagcttctggctacaccttcaccggcgactanctccacgtggtgcgacgacgccccgtggacaaggctgagtggagtggatggatacaaacccctaacaagtcggtggacaaacaaacgtatgacaacaagtaaacgtttcgagggtaccgacggtccaaccgagtacgaccgaagggaccacggtaccaanaccgagaccaacgacgacctaacgtagnggaacgcgtagacgacaacgtacgtaagtacagtctacggaaccgtacgaaccggtaccttaatttacgttaccgtagtagtaaccgtaggtaacgtttcggttaccggtacggtccgtttacggtttttcccgg

SEQ ID NO: 349644 - DNA, 673 bp, Homo sapiens
  misc_feature: GZ8MTXP02IDTHE.45.37.D04.1.454.CMB.2.raw
  modified_base (394)..(394): a, c, t, g, unknown or other
  misc_feature (394)..(394): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctggaggtgaggagccgtgggcctgagtgaaggtctccgtgacgaaggtcttcgtggtacctacctaccttccgaccggccgactactcctccgtacgtgggtcgaccgacgaccggcccgtggaacgaggtctaggagtggagtgggtatggactaccgaacccctaacgagtcggacgacaaactaaactncgtacgaacgtaagttaacgttacggagggacgtacgggtaccacgtagtaccgaaccggaacggaccctaccggtacaacgtccgaacacccgaacgtaacccgacccgtaagtaggtaccggaacgtcgaacggacgacgacgtacgtacgaacctagttaccgaacgggaaccgtaaccgtaaccggttacctttaaagtttaccgtaacgttggtacgtaacggtacgttaacggtttcgggttaccggtcggttacggtttttccgtttaccgg

SEQ ID NO: 349645 - DNA, 643 bp, Homo sapiens
  misc_feature: GZ8MTXP02INP3Q.45.37.D04.1.454.CMB.2.raw
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (444)..(444): a, c, t, g, unknown or other
  misc_feature (444)..(444): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaggtctctgcagctcnggctacnccttcaccggcgactatcctccacgtgggtcgcgacgacggcccctggacgagggtcttggagtggagtgggatggatccaaccccgtaacagtggtaggacaacgaaactgtagacaacgagtaagtttcgagggtcgacgggtcaaccgagtacgacgaagggacaccgtacagtcgacgcaacncggtacctaacgtagtcgggaacgtcgtaggacgtacgaagacgtagaaccgtacgtaccgtaacggaccggaaccgtaaccgggtaacccttaagttttaacgtttaaccggttggttacgggtaacggtaacgggttaacggttttacggggttttaaccgggtcgggtttaccggttttcgggttttttaccccgg

SEQ ID NO: 349646 - DNA, 750 bp, Homo sapiens
  misc_feature: GZ8MTXP02GN6AS.45.37.D04.1.454.CMB.2.raw
  modified_base (252)..(252): a, c, t, g, unknown or other
  misc_feature (252)..(252): n is a, c, g, or t
  modified_base (718)..(718): a, c, t, g, unknown or other
  misc_feature (718)..(718): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgagggtgaggaagccgtggggcctcgagtgaaggtctcctgcaggcttcnggctacaccttcgaccggcgactatcctccacgtgggtcgcgacgacgggcccctagggaactaaggggtcttggaggtgggagtggggtatacgggaactaccgtaaacccgtaaacgaaggttcggggtacggaaccaaactaaaaccgttgtacggtaccgaaacggtaaacggttaaacggtttccggaaagggggtaccgtaaacgggggttacccaaaccggttaacgtaccgggaaacccggtaagggggaaccctaaccgggttacccaacgtaccggaacgacccaacgtaaccggtaccccttaagacggttacggggacgtaccggttagaacggacgaacggtacgtaacggactaacgtttaccgtaacggaaacccggaaccgaccggttaccttaacgtttaacgttaccgtaggtacggacggtaaggttacggtttacggtttacgggnggtttaccgtttccggttttacgtttaccggg

SEQ ID NO: 349647 - DNA, 656 bp, Homo sapiens
  misc_feature: GZ8MTXP02FVXFL.45.37.D04.1.454.CMB.2.raw
  modified_base (265)..(265): a, c, t, g, unknown or other
  misc_feature (265)..(265): n is a, c, g, or t
  modified_base (365)..(365): a, c, t, g, unknown or other
  misc_feature (365)..(365): n is a, c, g, or t
  modified_base (386)..(386): a, c, t, g, unknown or other
  misc_feature (386)..(386): n is a, c, g, or t
  modified_base (495)..(495): a, c, t, g, unknown or other
  misc_feature (495)..(495): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctccgtgctaaggcttcgtggctacnccttcgaccggcactatcctccacgtggtgaccgacgacggtccccgtaggacgaagggtccttggaggtggagtgggatggataccgaaacccccgtanagtggtcgacaacgaaacttngacaacgtagtaagtttcgagggctaagggtcaaccgatacggaaccgaggggaccaccggttacacgacgaccgactaaccgacggaccctaacgacgtgggaaccgngtacggacgacgaaaggtaccttagggtaaacccgtacgtacgtaaccgaacccggtaaaccgtaccggttaacgtttaacgtttaccgtacgtcggtacggtaacggtacggttacgtttaccggggttacggtacggtttacggtttaccggttttacg

SEQ ID NO: 349648 - DNA, 707 bp, Homo sapiens
  misc_feature: GZ8MTXP02JNVXJ.45.37.D04.1.454.CMB.2.raw
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagacgcccactcccaggtgcagctggtgcagtcgtgggctggaggtgaggacgcgtgggctcgagtgaggtctcgtgnagtcttcgngctacncctcgaccgcactcnctccacgtggcacgcgacggtccccgtaggacgagggtctaggaggtggagtgggatcggaactaccgaaaccccccgtaaagtaacgtcggggtacgaacctaaaacgtaaaccgtagtacggaactaaacggtaaacgttaacgggtttcggaaacggggtaccggtaacggggtacccaaccgtaaggtaccggaaccggaacggggtaacccacccggttaaccaacgacgaccggaccaaccgtaccgtaacctaacggtacgtacgggacgtaccgtagaaccgacgaaccggtacgacgacctacgtccgaacggaaccgaccgtaaccggtaacttaacgtttacgttacggtacggtacggtaacggtaacggttacggtttaccgggttacggttcggtttaccggtttcggtttttaacccgg

SEQ ID NO: 349649 - DNA, 757 bp, Homo sapiens
  misc_feature: GZ8MTXP02JG7RU.45.37.D04.1.454.CMB.2.raw
  modified_base (197)..(197): a, c, t, g, unknown or other
  misc_feature (197)..(197): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgnggggctggaggtgaggaagccgtggggcctcgagtgacggtctccgtgacgaggtcttcgtggctacaccttcgaccggctactacgtcctccgacgttgggcgaccgacgaccggtccccgtaggaaccgaaggggtcttaggacggtggtagtaggggtagtcggaactacccgaaaaccccccgttaagaacggttggacggaccaaaacctaaacgttgtaccgactaaaccggtaaagtacggtttacggaaggggtaccgtaacggggtaccacccgtaagtaccggaaccgacggggaacctacccggtacaacgttacccgaagacccaaacgaccgtacccttaaacgacgtacgggacgtaaccgtagaacggtaaccgacggttaacgacgaaccgtacggtaccgaacggtaaaccggaccgtaaccggtaacttttaaacgtttaacgttaaccgtcgggtttacgggtaaccggtaaggggtttaacgtttcccggggtttaacgggttcgggttttacccggtttcggttttttaaccccggggg

SEQ ID NO: 349650 - DNA, 585 bp, Homo sapiens
  misc_feature: GZ8MTXP02GWPOH.45.37.D04.1.454.CMB.2.raw
  modified_base (462)..(462): a, c, t, g, unknown or other
  misc_feature (462)..(462): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctctgcaaggcttctggctacaccttcaccggcgactatctccactgggtgcgacacggcccctaggacgaagggcttggaggtggagtggggatgggataccccaaaccctaacgaagtggtggacaacgtaacctatggacacgagtaagtttcgagggcgagggtacacgacgtcgaccgagggaccacggtacatcacgacacacgcctacgatgggancgtgacgcgaacacgtagacagtcgtagacgaacgaccggtactaacgtttaacttaccgtaggtaaggtaccggtaaggttacggttaccggtttaaccgggtcggttacggtttttccggg

SEQ ID NO: 349651 - DNA, 609 bp, Homo sapiens
  misc_feature: GZ8MTXP02HJD93.45.37.D04.1.454.CMB.2.raw
  modified_base (389)..(389): a, c, t, g, unknown or other
  misc_feature (389)..(389): n is a, c, g, or t
  modified_base (563)..(563): a, c, t, g, unknown or other
  misc_feature (563)..(563): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggagatcctcttcttggtggcagcagccaacaagacgacccactcccaggttgcagctggtgcagtctggggctgaggtgaggaagccgtggggcctcgagtgaaggtctcctgacaaggcttactggcctacaccttcaccggcgaactatcctccacgtgggtcgccgacgacggccccctaggaaccgaagggctttgaggttggatgggatggatacccaaaacccttaacagtcggtgaccaaacaacttntacgacaacgagtaacgtttacgagggcaggtccaaaccgatacgaacccgagggaaccacggtaccaagtaccaagacaacacgacccttaacgagttaccgggaagcgtagacgacgaacgaccgtacgacacgtcgaacgaaccgaaccgacgtacttaagtttactacgngtaacgtacgtaacgttacgttacggtttaccgtcgttacgtttcg

SEQ ID NO: 349652 - DNA, 656 bp, Homo sapiens
  misc_feature: GZ8MTXP02I8H2F.45.37.D04.1.454.CMB.2.raw
  modified_base (272)..(272): a, c, t, g, unknown or other
  misc_feature (272)..(272): n is a, c, g, or t
  modified_base (292)..(292): a, c, t, g, unknown or other
  misc_feature (292)..(292): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgagtgaggagctggggctcagtgaggtctcctgcaaggcttcgtggctacaccttcaccggcgactacncctccacgtggtacgcgacncggcccctggacaagggcttgagtggatgggatggatcaacccctagaagtggacggcaacgtaaacgtgtgactaacgagtaacgtttacgagggcgtacggggtccaaccgtaacgtcgaacccgtaaggggtacctacccggtccaacgttccgaacggccgtaacgtacggacccttaacgtacgtacggggaccgtacgttacggaacggtaccgtaacgggtaactacgggacttaacgtccggtaacggtaaccgaccggtaacggttacccgtagttttaacccgtaacggtccgttaagaaccggtaacggtacgtttcgggtttaaccggcggtttcgttacggttttaccccg

SEQ ID NO: 349653 - DNA, 663 bp, Homo sapiens
  misc_feature: GZ8MTXP02FHIK9.45.37.D04.1.454.CMB.2.raw
  modified_base (259)..(259): a, c, t, g, unknown or other
  misc_feature (259)..(259): n is a, c, g, or t
  modified_base (542)..(542): a, c, t, g, unknown or other
  misc_feature (542)..(542): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggaagccgtggggcctcagtgaaggtctcctgcagcttctgctacncctcaccggcgactactcctccacgtgggtcgcgaccgacggcccccgtaggaccgaaggggtccttaggacgggtgggaggttggggaatcggggtaaacttacccgaaaaccccccgtaaacgaaacgtggggtacggaccaaaccgtaaaacttagcgaacacgtaaaggttaacgtttcgaaacggggtcgaacggggtaccaaacccgagtacggaacccgaacggggaccaccggtaccacgtcacgacacgacgacctacaagttgggacgtacgngacgacgacgacagactagtacgacgaccgaccgaccgtacttaactttacgttacgtggtacggaacggtaggttacggtttacgggttaccggttacggttcgtttacggtttttaccg

SEQ ID NO: 349654 - DNA, 609 bp, Homo sapiens
  misc_feature: GZ8MTXP02HG0FY.45.37.D04.1.454.CMB.2.raw
  modified_base (352)..(352): a, c, t, g, unknown or other
  misc_feature (352)..(352): n is a, c, g, or t
  modified_base (375)..(375): a, c, t, g, unknown or other
  misc_feature (375)..(375): n is a, c, g, or t
  modified_base (452)..(452): a, c, t, g, unknown or other
  misc_feature (452)..(452): n is a, c, g, or t
  modified_base (484)..(484): a, c, t, g, unknown or other
  misc_feature (484)..(484): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccaggtgcagctggtgcagtctgggctggaggtgaggaagccgtggggcctcgagtgaaggtctcctgcaaggtcttcgtggctacaccttcaccggcgactatctccacgtgggtgcgacgacggccccctaggacgaagggcttggagtggagtgggatggatacaaacccctaanaagtggtggacaacaaaactagngacaaacagtaaacgtttcgagggacgagggtccaacctagacgaaccgaacggacaccgtccaatacagccaaacncgacctacctagagggacgacgtaggacgtanaacgcgttagaaacacgtctacggaaccgtaccgaacccggtaccttaaagttttaccttacgtcggtcgtaaccggaggtcggtttacggttaccgggtcgtacgttttacgggtttttcccgg

SEQ ID NO: 349655 - DNA, 679 bp, Homo sapiens
  misc_feature: GZ8MTXP02IXKXS.45.37.D04.1.454.CMB.2.raw
  modified_base (259)..(259): a, c, t, g, unknown or other
  misc_feature (259)..(259): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcagtgaggtctctgcaggcttcgtggctacnccttcaccggcgactatcctccacgtggtgcgacgacggccctaggacgaaggtcttagaggtggatagggatggactaccaaaccccctaacgagtggtacggaccaaacgaaactgtacgacctaaacgaagtacgtttacgacgggggtcgaaacgggggtaccaacccgtaagtaccggaaaccggaacggggaaccgtacccggtaacctacgtaccgaaacgccaaacgaaccgtacccttaacgacgtagggtacgccgttacggaggccgtaacggaaccgttggaacacttccgacggtaaccggaaccgaaccggtactttaaacttttaacgttaacccgtggttacggaacggtacgggtaagtttaccgggtttacggtcgggttaccgtttcggttttttacccgg

SEQ ID NO: 349656 - DNA, 595 bp, Homo sapiens
  misc_feature: GZ8MTXP02HCRG4.45.37.D04.1.454.CMB.2.raw
  modified_base (247)..(247): a, c, t, g, unknown or other
  misc_feature (247)..(247): n is a, c, g, or t
  modified_base (447)..(447): a, c, t, g, unknown or other
  misc_feature (447)..(447): n is a, c, g, or t
  modified_base (472)..(472): a, c, t, g, unknown or other
  misc_feature (472)..(472): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagcgtgggctgagtgaggtctctgcaggcttcgnggctacaccttcgaccggcactatcctccagtgggtcacgaccgacggccccgtggaacgaggtcttggagtggagtgggatggactaccgaaaccccctaagagtgggtacgactaaacgaaaccttgagacacgtaagtacgttcggacgggacgtagggtaccaacgtagcggaaccgagggaccaccgtaccgaanaccgacgcaaccggctaccctacgnggacgacgacaggacacgaggactagactagccgtacgacggtacacggtacttacgttacgtaccgtgtaacggcgtaaggttcgttacggtttcggcgtttcggtttccgttttaaccggg

SEQ ID NO: 349657 - DNA, 633 bp, Homo sapiens
  misc_feature: GZ8MTXP02GSRZ2.45.37.D04.1.454.CMB.2.raw
  modified_base (254)..(254): a, c, t, g, unknown or other
  misc_feature (254)..(254): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctgaggtgaggaagcgtggggctgagtgaggtctctgcaggcttctggctacncctcgaccggcactatctaccgacgtggtcgcgacgaccggccccgtaggacgaagggtcttaggaggtggagtgggatggactaccaaaccccgtaacgagtggtacgacaaactaaactgtacgacaacgaagtaacgttacgacgggtcgaacggtaccaacccgtagtacgaaccggaaggtaaccacccggtaccaataccgacgacctaaacgacggtacctaacgagtagggaacgcgtagaccgagaacgacgtagaaactcgtacgtaaccgaccggaaccgtaccggtacctttaaagtttaacgtacgtagtacggaagtaacggtacgtttacggttaccggtcggtaccgtttcggtttttaccgg

SEQ ID NO: 349658 - DNA, 690 bp, Homo sapiens
  misc_feature: GZ8MTXP02GHQRR.45.37.D04.1.454.CMB.2.raw
  modified_base (306)..(306): a, c, t, g, unknown or other
  misc_feature (306)..(306): n is a, c, g, or t
  modified_base (526)..(526): a, c, t, g, unknown or other
  misc_feature (526)..(526): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaaggtgcagctggtgcagtcgtgggggctggaggtgaggaagccgtggggcctcgagtggaaggtctccgtgacgaggcttacgtggctacgacccttcgacccggcgactactcctaccagtgggtnccgacacggccccctggacgaagggtcttaggaggtggagtggggatggactaccaaccccccgtaaagaacgtggtacggacctaacaaaactgtacgacaacgtaacgtaagttaccgaggggccgagggtaccacagtacgaccgaggtaaccacgttaccagtcgaacgaccaacgaccgaacccgtaacgtacggtaccggagtacgacgggaanaccgacggtaactacgaacctagtaccgtaacggtaacgaaccccgaaccggttaaccttaacgtttaacgtttacccggtaggttacgaaccgggttagggtaaccgtttttacgggggtttacccggtttaggtttaccggttttacggggtttttaacccg

SEQ ID NO: 349659 - DNA, 753 bp, Homo sapiens
  misc_feature: GZ8MTXP02JFDIL.45.37.D04.1.454.CMB.2.raw
  modified_base (254)..(254): a, c, t, g, unknown or other
  misc_feature (254)..(254): n is a, c, g, or t
  modified_base (516)..(516): a, c, t, g, unknown or other
  misc_feature (516)..(516): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaacgccgtggggcctgagtgaggtctcctgcaggtcttcgnggctacaccgttcgaccggcgtactatcctccagtgggtcgcgacgaccggccccgtaggaacgagggtcttggaacggtggtagtaggggtatgggtaactaccgtaaacccctaacgtagtcgggtacggacctaaaacgtaaactcggtacgtacaaacgttacgggtaaacgtttacggacggggtaccgtaaacggggtcccaaacccggtagtacccggacggaacggaccgtaaacccgttaccagtaccggaanccgaaaccgtaggtaccccgtttaaacgagggttaccgggaacggtttacccggaggtacgtaacgggaacttaaaccggttaccggaaactttcccggaaactacggggttaaaaccccgacgttaaacccggtaaacttttacgtttaaacgttacggtaggtttacggcggtttaaaaggtcgtttacggggttaacccgggttcgtttccgttttaacggggtttttacccgg

SEQ ID NO: 349660 - DNA, 597 bp, Homo sapiens
  misc_feature: GZ8MTXP02JI185.45.37.D04.1.454.CMB.2.raw
  modified_base (283)..(283): a, c, t, g, unknown or other
  misc_feature (283)..(283): n is a, c, g, or t
  modified_base (548)..(548): a, c, t, g, unknown or other
  misc_feature (548)..(548): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcgagtgaaggtctccgtgcaaggtcttcgtggctactaccttcgaccggcgaactntcctccacgtggtgcgacgcggcccctggacaagggtcttggagtggagtgggatggactcaaacccctagaatcggtgacacgaaactgtgactacgagtaagtttcgagggcgaacgggtcaccgagtacgaccgaaggggacaccgtacgacgtacacgacctaacggactacctaccgagttagggaacgtccgagaagccgaggttaaccgtagactacgtacgtacgacgtaccgtacgtacttacgtttacgttacgnggtcgaacgtacgtacggttcggttaccggtcggttcgtttcggtttcg

SEQ ID NO: 349661 - DNA, 608 bp, Homo sapiens
  misc_feature: GZ8MTXP02F3VX0.45.37.D04.1.454.CMB.2.raw
  modified_base (403)..(403): a, c, t, g, unknown or other
  misc_feature (403)..(403): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
  modified_base (475)..(475): a, c, t, g, unknown or other
  misc_feature (475)..(475): n is a, c, g, or t
  modified_base (494)..(494): a, c, t, g, unknown or other
  misc_feature (494)..(494): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgagagggccaccatcaactgacaagtccagccagtagttgtttagacagctaccaaacaataagaacttacttaagcttaggtaccagacaacgaaaccaggtcacgcctacctaagctgcttacgtatttacgcggtctacgtccgtaacccggggtaacgttccccggggtcccctacggacccgtattaccgaggtcggcgngggtccgggtacgtgggacctagtacttcaactctacaccatcacgacngcccngaccagggccagaaaggngtcggtgtattagtttacngtctgacagtacttaattatttaacgtacttacgttcccgtacgttaccgtttccggaccgtaacggaacgtaagtagaacttaacgtaacgtaaacgtgtacgtacgtacacg

SEQ ID NO: 349662 - DNA, 598 bp, Homo sapiens
  misc_feature: GZ8MTXP02J24P8.45.37.D04.1.454.CMB.2.raw
  modified_base (184)..(184): a, c, t, g, unknown or other
  misc_feature (184)..(184): n is a, c, g, or t
  modified_base (363)..(363): a, c, t, g, unknown or other
  misc_feature (363)..(363): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacgggacatcgtgatgacccagtctccagactccctgctgtntctctggcgagagggccaccatcaactgcaagtccagccagagtgttttagacagctacaacaataagactactagcttggtaccagcagaaaccaggtcacgcctctaagctgctactatttactgggctagtccgtaacccgggaatcccggggtcccctgaccgattcagtcggcnggcgggtctggggacagtctttcactctaccaccatcagcacggccctgcaggctagaaagtgtggtggtacctaggtttagttcgtacttcggtacagacctaaatttacttaaattattaacttcccttaccgtaaccgttttccggacccgtttacggggaacccttaaaaggtttaggaacgtttaaacgtaccaaaacggtaacgtacggtttaacggacctttacccgg

SEQ ID NO: 349663 - DNA, 572 bp, Homo sapiens
  misc_feature: GZ8MTXP02F39QU.45.37.D04.1.454.CMB.2.raw
  modified_base (459)..(459): a, c, t, g, unknown or other
  misc_feature (459)..(459): n is a, c, g, or t
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagcccactccccaggtgcagctggtgcagtcgtggggctgaggtgaggaagccgtggggcctcagtgaaggtctcctgcgaaggcttcgtggctacaccttcaccggcgactatcctccacgtgggtgcgacacggccccctggacaagggtcttgagtggatggggatggataccgaaaccctaaccgaagtgggtaggacaacgaaaacttagtcgacaacgtaagtaacgtttcgaggggacagggtcaccagtacgacgaggacacgtacatcagacacacgaccctaanagtaggagcgtagacgcagacgtgacatcgagaccgacgaccggtactaagtttactacgtgtagacggaagtgttacggtttacgggtgtcgtttcggtttacgttttacgg

SEQ ID NO: 349664 - DNA, 622 bp, Homo sapiens
  misc_feature: GZ8MTXP02FMXEO.45.37.D04.1.454.CMB.2.raw
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggagcctgggggcctcagtgaggtctcctgcaaggcttctggctacaccttcaccggcgactatctccacgtgggtgcgacagggccccctggacaaggggcttggagtggagtggggatgggataccaaacctaacagtggtagacaacaaactatgacaacagtaagttcgagggcacgggtcacgagtcgaacgagggaacaccgtccaatcaagaccacgacgaccctaagacggtagggacgtacgtagaacgacgaacggtactacggacctaatccgtaacggaaccgacgaaccggtaccttaattttacgttaccgttaggtacggtacgggtaaacgggttacgtttacggggtttaaccgggtcggtttaccggtttacggttttaccggtttttaacgggg

SEQ ID NO: 349665 - DNA, 558 bp, Homo sapiens
  misc_feature: GZ8MTXP02F6GJZ.45.37.D04.1.454.CMB.2.raw
  modified_base (227)..(227): a, c, t, g, unknown or other
  misc_feature (227)..(227): n is a, c, g, or t
  modified_base (326)..(326): a, c, t, g, unknown or other
  misc_feature (326)..(326): n is a, c, g, or t
  modified_base (367)..(367): a, c, t, g, unknown or other
  misc_feature (367)..(367): n is a, c, g, or t
  modified_base (465)..(465): a, c, t, g, unknown or other
  misc_feature (465)..(465): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctnagtgaaggtctcctgcaaggcttcgtggctacaccttcgaccggcgactatcctccacgtgggtgcgacacggcccctggacgaagggcttggagtggngtgggatggatcaacccctacaagtggtagacaacaaactntgacacgagtaagtttcgacggggctaaggggtcaaccgagtacgaccgaggacaccgtcagtcagcaacacgcctacgagtaggacgacgtagacgnaagactagacatcaggaccgacacggacttagtttacttacgtcgtagaacgtaggtacgttacggttaccggtggttcgttcggtttttccg

SEQ ID NO: 349666 - DNA, 646 bp, Homo sapiens
  misc_feature: GZ8MTXP02FIV28.45.37.D04.1.454.CMB.2.raw
  modified_base (387)..(387): a, c, t, g, unknown or other
  misc_feature (387)..(387): n is a, c, g, or t
  modified_base (592)..(592): a, c, t, g, unknown or other
  misc_feature (592)..(592): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctctgcaaggcttctggctacaccttcgaccggcgactatcctccagtgggtgcgacgacggccccgtaggacgaagggtcttaggagtggagtgggatggactaccgaaaacccctaacgtaagtgggtcggaacaaacgaaaacttnacggacaacgtaaagttaacgtttcggaagggtacgtaacggggtccaaaccgtagtacgaaccggaacggggaccaaccggttaccaatcgaacgcaaacgacggaacctacgagtagggacgacgtaggacgacgaacgacctaggaactacgtacgtaacggaaccgaccgtaacggtaccttaaattttacgtttaacggnggtacggaaggtacgttacggttacggttacggtcggttcgtttacggtttacg

SEQ ID NO: 349667 - DNA, 595 bp, Homo sapiens
  misc_feature: GZ8MTXP02H3TUF.45.37.D04.1.454.CMB.2.raw
  modified_base (254)..(254): a, c, t, g, unknown or other
  misc_feature (254)..(254): n is a, c, g, or t
  modified_base (373)..(373): a, c, t, g, unknown or other
  misc_feature (373)..(373): n is a, c, g, or t
  modified_base (551)..(551): a, c, t, g, unknown or other
  misc_feature (551)..(551): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaaggtctcctgcaaggcttcnggctacgccttcaccggcgactactcctccacgtgggtcgcgacgcggcccctggacgaggcttgagtggagtgggatgagtaccaaccccgtaacagtggtacggacaacaaactgtnacaacgaagtaagtttcgaagggcgaacggggtcaacgtacgacggacccgaggggaccaccggtaccaactacgacgcaacgaccggacctacctaagtcgggacgccgtaggagaccgagacgtagactagtcgtacgaacgaccgaccggtactaactttacgtaactgtacggngtaggtaacgtttcggttacggtaggttcgtttcggtttttccg

SEQ ID NO: 349668 - DNA, 609 bp, Homo sapiens
  misc_feature: GZ8MTXP02FMENU.45.37.D04.1.454.CMB.2.raw
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (263)..(263): a, c, t, g, unknown or other
  misc_feature (263)..(263): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagcgtgggctnagtgagtctctgcagctngcacactcacgcactatcncacgtggtgcgacgacggccccgtggaacgagggtctggaggtggaggtgggatggactaccaaacccctaacgagtggtacgacaacaaactagtcgacaacgagtagttacgagggacgacgggtcacgagtacgacggaacggtacaccgtacgaactcgacgacaacgacgacctacgagtagggacgtacgacgaacgtacgaacggtacgtacgaacgtacgtaccgacggaaccgacggtaaccggtaccttaaagttttacgttacgtacgtacggtaacggtaacggttacggtttacggtttacccgggttcgttccggtttacggtttttaccgg

SEQ ID NO: 349669 - DNA, 628 bp, Homo sapiens
  misc_feature: GZ8MTXP02HM775.45.37.D04.1.454.CMB.2.raw
  modified_base (449)..(449): a, c, t, g, unknown or other
  misc_feature (449)..(449): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgacaagtccagccagacgtgtttagacagctaccaacaaataagaactactagcttaggtaccagcaagaaaccaggtcacgcctacctaagctgcctactatttacgcggacagtccgtacccggggaaacgttcccggggtccccctacggacccgtaattccgagtcggcgcgggtccgggtcgtaggggactagtactttcacttccacaccctatccagcgacgtccngccgaggtctaggaaagtgtggtaaggtcttaaaggtttcgtgtacgttcggtacagttataaatttattaaattacttaactttcccgttaccgttaaccgttcccgggtacccttacgggaaaccctaaaaggtcgtaataaaccggactaaaacccggtatccggtggttacaccg

SEQ ID NO: 349670 - DNA, 624 bp, Homo sapiens
  misc_feature: GZ8MTXP02F4PR2.45.37.D04.1.454.CMB.2.raw
tcagacgcgatcgacacgaccggtgctcgatttagtagcatactgttgggtttggggcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggagccgtggggcctcgagtgaaggtctcctgcaaggcttctggctacaccttcgaccggcgactatcctccgactggggtgcgaccaggccccctggacaagggcttggagtgggagtggggataaggataccaaacctaacgaacgtgggtaggacaacgaaaactagtcgacaacgaagtacgtttaccgaagggccgagggtacaccgaagtcgaaccgagggaccacgtccaagtcagaccagacgactacagtggatcgagacgctaagactagacagtcgtacgaacgaaccgacgggtaccctttaaagtttaacttaccgttaggtcgtaaccgggaaggtttaacggttaccggtttttacccggggtagggttaccgtttacgggtttttccgtttttaacgggg

SEQ ID NO: 349671 - DNA, 636 bp, Homo sapiens
  misc_feature: GZ8MTXP02IX2O8.45.37.D04.1.454.CMB.2.raw
  modified_base (366)..(366): a, c, t, g, unknown or other
  misc_feature (366)..(366): n is a, c, g, or t
  modified_base (388)..(388): a, c, t, g, unknown or other
  misc_feature (388)..(388): n is a, c, g, or t
  modified_base (454)..(454): a, c, t, g, unknown or other
  misc_feature (454)..(454): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctgaggtgaggaagccgtggggcctcgagtgaacggtctctgcaaggtcttcgtggctacctaccttccgaccggcgaactactcctccacgtgggtcgcgacgaccggcccctaggaccgaagggtctggaggtggagtggggatcggataccaaccccctaanagtgggacgacaacctaaactnacgaacactaagtaacgttcgaacgggcgaacgggtacaaccgtagtaccgacggaacgggaaccncgtaccagtacacgacaccgacgtacctaacgagtacggagtcgacgacgacgacgtaactacgactactcgtaacgaccgtaaaccgaccggtactttaaactttacgttaacgtgtaacggcggtaacggttacgtttaccgggtttaacggtcggtttcggttttccggtttttaccgg

SEQ ID NO: 349672 - DNA, 540 bp, Homo sapiens
  misc_feature: GZ8MTXP02HMDEO.45.37.D04.1.454.CMB.2.raw
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
  modified_base (363)..(363): a, c, t, g, unknown or other
  misc_feature (363)..(363): n is a, c, g, or t
  modified_base (425)..(425): a, c, t, g, unknown or other
  misc_feature (425)..(425): n is a, c, g, or t
  modified_base (441)..(441): a, c, t, g, unknown or other
  misc_feature (441)..(441): n is a, c, g, or t
  modified_base (455)..(455): a, c, t, g, unknown or other
  misc_feature (455)..(455): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctnagtgaaggtctcctgcaaggcttcnggctacaccttcaccggcgactatctccactgggtgcgacacggcccctggacaagggcttgagtggatgggatggatcgaaaccccctaacaaatggtggacaacaaacgtntagcaacagtaagtttcgaagggcagggtacaccatcgacgagggacacgtccatccagcanacgctacagaggagcngacgacagtaaccngacactcgacgacgacgaccgtaccttaatttacgtacgtgagaacgtaggtacgttacggttacggtcggtcgtttcggtttcg

SEQ ID NO: 349673 - DNA, 612 bp, Homo sapiens
  misc_feature: GZ8MTXP02F0JT3.45.37.D04.1.454.CMB.2.raw
  modified_base (251)..(251): a, c, t, g, unknown or other
  misc_feature (251)..(251): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtgggcctcagtgaggtctctgcagctcgtgctacnccttcaccggcgactatctccacgtggtgccgacgacggcccccgtggaccgaagggtcttggacggtggagttggggagtagggaactaccgaaaccccctaacgaaagtgggtacggacctaaacaaactacgtcgacgaaacaaggtaaacgtttacgaacggggtcgtaacggggtccaaacccgagtacgaaccgaagggacaccgtaccaagtcacgcaacgacgaccctacgtagtggaacgcaacgagacaacgactagactacgtacgacgaccgtacgacggtacctaatttacttacgtgtacgaagtaacgtacgttacggtttacgggtgtacgtttcggttttaccg

SEQ ID NO: 349674 - DNA, 639 bp, Homo sapiens
  misc_feature: GZ8MTXP02GT1UX.45.37.D04.1.454.CMB.2.raw
  modified_base (452)..(452): a, c, t, g, unknown or other
  misc_feature (452)..(452): n is a, c, g, or t
  modified_base (465)..(465): a, c, t, g, unknown or other
  misc_feature (465)..(465): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtcgtggggctgaggtgaggaagccgtggggcctcgaggtgaaggtacctccgtgcaaggtcttcgtggctacaccttcgccggcgtactactctaccgacgtgggtcgccgacgacggccccgtaggacgaagggcttggacgtggagtggggtatggactccaaaccccgtaacgagtggtacgacaacctaaactgtgacacgagtaacgttgaagggtcacgggtacactagtcgaacgagacacgtcactcganacgacacgaccanagtagacgactaggacgcgaacgacgttacgacgtacgtaccgtaaccgaacgcccggttaaacggacctttaaacggttttacctaaacgttccggtaaggtaacggtaacgggttaacgttttcggggtttaacccggttcggtttaacgggtttccgttttttaacccggg

SEQ ID NO: 349675 - DNA, 771 bp, Homo sapiens
  misc_feature: GZ8MTXP02JE9NF.45.37.D04.1.454.CMB.2.raw
  modified_base (260)..(260): a, c, t, g, unknown or other
  misc_feature (260)..(260): n is a, c, g, or t
  modified_base (534)..(534): a, c, t, g, unknown or other
  misc_feature (534)..(534): n is a, c, g, or t
  modified_base (609)..(609): a, c, t, g, unknown or other
  misc_feature (609)..(609): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgaggacggccaccatcaactgacaacgtccagccagtagttgtttagacagcctaccaaanaataaagaactacttagcttacggtaaccagacaacgaaaccgagtacacgtcctaaccgtaagcgtcgtcctacttaacgtttacgtacgggtacctaacgtaaccccggtaaccccggggtaaaccggttcccccggggtacccccgtaccggtaaccccgtaacttaccggaaggggttccgggaaccggtacgggggtcccgggggttacggtaacgggggtaaccgtacggtttactttacccgtacctttacccaccgaaacccgttntaccggaacgtcccgaacgtccgtacgaccgtagggtcaaaggaaagtgttgggtcgtacgtttagtttagtcgnggttacaacgtataacttaaattttaactttacttaaccggttccctttacccggtaacgtttaccccgggtttccgaacccggtaaacggtaaaacgttaagggtagtaaactttaaacgaaacccggtaaaaggttccgttgggtccgaccttaaacccg

SEQ ID NO: 349676 - DNA, 716 bp, Homo sapiens
  misc_feature: GZ8MTXP02II1S0.45.37.D04.1.454.CMB.2.raw
  modified_base (255)..(255): a, c, t, g, unknown or other
  misc_feature (255)..(255): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagagcccactcccaggtgcagctggtgcagtcgtgggctgaggtgaggaagccgtgggcctgagtgaaggtctcgtgacaaggtcttcgnggctactaccttcgaccggcgactatcctaccgacgtgggtgccgacgaccggccccgtagggaacgaacgggtcgttaggaacggtgggtaagtaggggtaagtagggaaccttaaccgaaaacccccccgtaaaacgaaacggtgggtacggaacaaaaccgtaaaactacgtacgaacaaacgtaaagtaaacgtttcggaacggtcggaaacgggtaccaaaccgtagtacgaaccggaacggaaccacggtaccaataccgagaccaaacgtaccgaccgtaagaagtcggaacgcgtacggaacgacgaagtacgtaacgactacgtaccgtacggtaaaccgaacccgaaccggttaaccttaaagttttaccgtaacgttacgtacggtaacggtaaggttacgtttaccgggtttaaccgggtcgttaaccgttttcggtttttaaccccgg

SEQ ID NO: 349677 - DNA, 611 bp, Homo sapiens
  misc_feature: GZ8MTXP02FZWON.45.37.D04.1.454.CMB.2.raw
  modified_base (191)..(191): a, c, t, g, unknown or other
  misc_feature (191)..(191): n is a, c, g, or t
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
  modified_base (273)..(273): a, c, t, g, unknown or other
  misc_feature (273)..(273): n is a, c, g, or t
  modified_base (281)..(281): a, c, t, g, unknown or other
  misc_feature (281)..(281): n is a, c, g, or t
  modified_base (312)..(312): a, c, t, g, unknown or other
  misc_feature (312)..(312): n is a, c, g, or t
  modified_base (357)..(357): a, c, t, g, unknown or other
  misc_feature (357)..(357): n is a, c, g, or t
  modified_base (454)..(454): a, c, t, g, unknown or other
  misc_feature (454)..(454): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggagatcctcttcttggtggcagcagccacaagacgcccactcccaggtgcagctggtncagtcgtgggctggaggtgaggagccgtgggcctgagtgagtctcngcgagcttcgtgctacncctcgaccggcactctccncgagtggngcgacgcggcccagaccgaggtctgagtggngtggatggactaccaaaccctacgagtggacgacaacgaatcganacgagtaaagtacgttacgagggtacacgggtacacgagtacgacgaaggacaccgtacacgtacacgaccaacgacacctaacgagtaggacgtanacgacgacgagtacgacgaactacgtcgaacgggaaccgtaccacgggtaaacctttacgttttaacttacgggtccgttaagggaaccggttaaggtttacgtttaccgggggttttacccggtgggttttacccggtttcggtttttaacccggg

SEQ ID NO: 349678 - DNA, 597 bp, Homo sapiens
  misc_feature: GZ8MTXP02GJMCG.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgagggaagccgtggggcctcagtgaaggtctctgcaggcttctggctacaccttcaccggcgactatcctccacgtgggtgaccgacgacggcccccgtggaacgaaggggtccttggaggtgggagtggggagtggactccaaaccccctaaactagtggtggacaacaaaactgtagacaacgtaagtaacgtttcgaggggcgacgggtacaacccgagtacggaccgaaggggactaccggtacactacagaccacgacgctacagtaggagtcgagacgcaggacctgaacagtacgtacgacgaccgtaccggtacctaacgtttacttaccgtgtagaacgtaggtacttcggttacggtcggtcgtttcggttttaccgg

SEQ ID NO: 349679 - DNA, 671 bp, Homo sapiens
  misc_feature: GZ8MTXP02JY5PH.45.37.D04.1.454.CMB.2.raw
  modified_base (402)..(402): a, c, t, g, unknown or other
  misc_feature (402)..(402): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagcgtggtgcgagtcgtggggctggaggtgaggaacgccgtggggcctcgaggtgaaggtctcctgcgaaggtcttcgtcggctaccacccttcgacccggcgtactaactcctccgacgtgggtcacggaccgacggcccccgtaggacgaagggtcttggagtggagtggggatggataccgaaaccccctaagagtggtagactaaacaaacgtnacgactacgtaagtaacgtttccggaggggacctaggggtacccaaccgagtacggaacccggagggacctaccggaccacacgacgaccacgacggtaccctaatacggtagggacgtacgtaggaacgacgtaacgacgtagaaacctgttacgtacggaaaccgtaccgacggttaccttaaagttttacgtaccgtacggtaggtaacggaaggttacggtttacgggtttaccggtcggtttacggttttccggttttaaccgg

SEQ ID NO: 349680 - DNA, 605 bp, Homo sapiens
  misc_feature: GZ8MTXP02ITJL7.45.37.D04.1.454.CMB.2.raw
  modified_base (393)..(393): a, c, t, g, unknown or other
  misc_feature (393)..(393): n is a, c, g, or t
  modified_base (410)..(410): a, c, t, g, unknown or other
  misc_feature (410)..(410): n is a, c, g, or t
  modified_base (427)..(428): a, c, t, g, unknown or other
  misc_feature (427)..(428): n is a, c, g, or t
  modified_base (430)..(431): a, c, t, g, unknown or other
  misc_feature (430)..(431): n is a, c, g, or t
  modified_base (434)..(434): a, c, t, g, unknown or other
  misc_feature (434)..(434): n is a, c, g, or t
  modified_base (454)..(454): a, c, t, g, unknown or other
  misc_feature (454)..(454): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggagggcccacatcaactgacaagtccagccagagttgtttagacagctaccaaacaataagaactacttagcttggaccagcaagaaaccaggtacagcctacctaagctcgctactatttacgtgggacctagtcccgtaaccccgggtaacgtcccggggtaccccctcggaccgtattccgaggtcggcngggcgggtcaggggacngtacttcactctcaccnncnnacnccgtgcgagcagaagagtgnggtcttagtttatgcttgacagtactaatttattaattacttcctttaccgttacccgttacgtttaccggtaccccgttacggggtaaaacctaagggttacggaatttaacgtaaccggtaaaaccgtacgttggtaccggacttaccg

SEQ ID NO: 349681 - DNA, 577 bp, Homo sapiens
  misc_feature: GZ8MTXP02H2AN4.45.37.D04.1.454.CMB.2.raw
  modified_base (246)..(246): a, c, t, g, unknown or other
  misc_feature (246)..(246): n is a, c, g, or t
  modified_base (462)..(462): a, c, t, g, unknown or other
  misc_feature (462)..(462): n is a, c, g, or t
  modified_base (473)..(473): a, c, t, g, unknown or other
  misc_feature (473)..(473): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggctgaggtgaggagcctgggcctcagtgaagtctcctgcaggcttcnggctacaccttcaccggcgactatcctccactgggtgcgacgacggcccctaggacgaagggtcttggagtggagtgggatggactccaaacccctaagaagtggtcggaccaacgaaaactgtacgacaacgtagtaacgtttcgaggggtaccacggggtcaaccgtagtacgaaccgagggacctaccgtaccatacagcaacgcgaccctanacgtaggagcngacgacacggactgactagtctacgacgacgaccggacctaagtttactacgttgacgtggtacggtacgttcggttaccggtcggtacgtttggttttcccgg

SEQ ID NO: 349682 - DNA, 697 bp, Homo sapiens
  misc_feature: GZ8MTXP02F7UIZ.45.37.D04.1.454.CMB.2.raw
  modified_base (263)..(263): a, c, t, g, unknown or other
  misc_feature (263)..(263): n is a, c, g, or t
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcgaggcttcgtggctacnccttcgaccggcgactactcnccgtacgtggtgcgacncggcccctggacgaaggcttggagtggagtgggtagtggaactaccaaaccccccgtaaacgaagtcgggtacggaccaaaaccgtaaaacttgtacgaccgaaacgtaaagggttaaacgttttcggaaagggggtaccggtaacgggggttaaccaacccgtaacggttaccggaaacccggaacggggaacccgtaccggttacccaacgttacgaccgacaacccgtaacgacccgtaacgtagtacggaggtccgagacggacgacgtacgtacgactacgtccgtacggaccgaccgtaccggtacttaacttttacgtacgttgtacggaacggttaacggtacgtttacggtttaccggttcggttccggtttacggtttttacccgg

SEQ ID NO: 349683 - DNA, 647 bp, Homo sapiens
  misc_feature: GZ8MTXP02FIP66.45.37.D04.1.454.CMB.2.raw
  modified_base (246)..(246): a, c, t, g, unknown or other
  misc_feature (246)..(246): n is a, c, g, or t
  modified_base (520)..(520): a, c, t, g, unknown or other
  misc_feature (520)..(520): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctggaggtgaggaacgccgtggggcctcgaggtgaacggtctccgngacgaggtcttcgtggactaccacccgttcgaccggcgtactactcctaccgtacggtcgggtcgaccggaccgaccggtccccctaggaacgaacgggtcgttgggaaggtgggagtggggtatggactaacccgtaaacctaacgtacggtaggtcgacaaacgaactgtcgacagtagtacgtcgaggcgacggacactagacgaacgaggacctacgactacgtacacgaccacgtacgtacctagaggtacggagtcgagacgacgtanaaccgtgaacgtactcgaacgaacgacgaccggtaacttatttaacgttacgtacgaacggtacggtaaggttacggttacgggtttacggtcgttacggtttaccggttttaccggtttaacgggg

SEQ ID NO: 349684 - DNA, 672 bp, Homo sapiens
  misc_feature: GZ8MTXP02F657D.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagcgtggtgcagtcgtggggctggaggtggaggacgccgtgggcctcgagtgaaggtctccgtgacgaaggtcttcgtggcctactaccttccgaccggcgactactcctccgacgtgggtcgacggaccgaccggtccccgtagggaaccgaacgggtccgttaggaggtggaggtgggagtggactaccaaaccccgtaacagtggtacgacaacaaacgtgtcgacaacgagtaagtttcggacggggacgagggtacaccgagtacggaacgtacgggacaccgtacacgtcacgccaacgacgacctaacgagtacggacgtcgacgacgacgaaggtaacacggaactacgtccgtaaacggaaccgtaaccggaacccggttaactttaactttaacgttaaccggtcggtaggtaacgggtaacggttacgtttaccggggtttacggggtcggtttcggttttccggtttttaaccggg

SEQ ID NO: 349685 - DNA, 620 bp, Homo sapiens
  misc_feature: GZ8MTXP02HDMY2.45.37.D04.1.454.CMB.2.raw
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggagcgtgggctgagtgagtctctgcgagtcttcgngctacnccttcgaccggcactactcctccgaggtgggtcgcgacgaccggccccgtaggaaccgaagggtcttaggaggtggacggtggggattcggaacttaccgaaaacccccgtaagacgtggtacgacaaactaactgtacgactaaacgtaagttacgttacgaaggggacgtaacgggtccaacgtagtaccggaaccgacgggaccttaccggaccaagaccaacgacaaccgacgtaccctagagcgggaactcgaagacgacgaagtcgacgaacgtctacgacggaaccgtcgacccggttattatttacctaggcgtaggaaccgtagtacgtttccggtaggtcttacgtttcgttttacg

SEQ ID NO: 349686 - DNA, 758 bp, Homo sapiens
  misc_feature: GZ8MTXP02HCQZ9.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagacgcccactcccgaggtgcagctggtgcagtcgtggggctggagggtaggaggaacgtccggtcggggcctcgagtggaacggtcctccgtgacgaaggtcttcgtcggcctaccgtacccttaccgaccggtccgtacctctcccgtaccgtacgtcgggtcgccggaacggacccggtccccgtaggaaccggtaacgggtcgttggaagggtagggtacggtagggtaacgtcggtaaactaccaaacccccgttaaacgaagttcgggtacggtaacccaaacgttaaaacgtcgtaccgtaacaaccgtaaacgggttaggtttacgggacgggtacgggttaaccgggtaccaaaccgttacgacggaaccggtaccggggaacctacccggtaccacgtaccgacgaccgacgtaaaccgtaccgtaagtcggttacggagtaccgtacggacgacgaacgacgttacgaacacgtaccgttaacggaccgtacggtaaccgtacgttaactttaacgtcgttggtaacggtcggtagtaaccggtttcggttaccggttggttccggttttacggtttaccgg

SEQ ID NO: 349687 - DNA, 656 bp, Homo sapiens
  misc_feature: GZ8MTXP02GZMZT.45.37.D04.1.454.CMB.2.raw
  modified_base (296)..(296): a, c, t, g, unknown or other
  misc_feature (296)..(296): n is a, c, g, or t
  modified_base (393)..(393): a, c, t, g, unknown or other
  misc_feature (393)..(393): n is a, c, g, or t
  modified_base (538)..(538): a, c, t, g, unknown or other
  misc_feature (538)..(538): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtcgcagctggtgcagtcgtgggctgaggtgaggagcgtgggcctgagtgaaggtctccgtgcgaaggtcttcgtggctacctaccttcgaccgggcactactcctccagtggggtncgacgacggccccgtaggacgaaggtcttggaggtggagtgggacgtggacttaccaaacccctaacgagtcgggtacggaccaaactaaaaccgtntcgacctaacgaagtaacgtttacgaacggggtcgtaagggtaccaaccgagtacgaccggaaacggtactaccgtaccactacgaacggccaaacgactaccgtaacgagtagggacgttacgacgacgaaccgttagacgtanaaactcttacggacgaaccgtaccgaccggtacttaaactttacgtaccgttacggaggtccgtaaaggttcggtttacgggttaacggttcggttccgttttacggttttaacccgg

SEQ ID NO: 349688 - DNA, 626 bp, Homo sapiens
  misc_feature: GZ8MTXP02FUBZD.45.37.D04.1.454.CMB.2.raw
  modified_base (297)..(297): a, c, t, g, unknown or other
  misc_feature (297)..(297): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagcgtggtgcgaggtcgtgggggctggaggtgaggagccgtgggcctgagtgaggtctctgcgaggtcttcgtggctactccttcgaccggcgactactcctcctagtgggtcncgacgacggccccgtggaacgagggtcttggagtggagtggatggactaccaaacccccgtaagtagtggtacgacaaactaaacgtgcgaccaacgtagtaacggtttacgaggggacgagggtccaacgtagacggaccgaggggaaccctaccggtaccaacgtacgaacgacgaaccgtacgaccctaacgagtggacgtacgacggacgacgaagttacgacgaatcgtaccgacgacgacgtaccggtacttagtttacgtacgtgtcggaacggtaagtacgtttaccggttacgggtcgttaccgtttcggtttttaccgg

SEQ ID NO: 349689 - DNA, 595 bp, Homo sapiens
  misc_feature: GZ8MTXP02FNUL4.45.37.D04.1.454.CMB.2.raw
  modified_base (252)..(252): a, c, t, g, unknown or other
  misc_feature (252)..(252): n is a, c, g, or t
  modified_base (288)..(288): a, c, t, g, unknown or other
  misc_feature (288)..(288): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcagtgaaggtctcctgcaggcttcnggctacaccttcaccggcgactatctccactgggtncgacgacggcccctggacgaagggcttggagtggacgtgggatggactacaaacccccctaagaagtgggtggacaaaccaaaacgttgacgacaacgaagttaacgttcgaggggacgaggggtaccaaccgagtacgaaccgaaggggaccaccggtaccatccgagcaacgacgacctacagtcggagtccgagagcagactgacatacgacgaacgaccgtacggaccttagtttacgtacgtgtacgaacggtaggttaacgtttcggttaaccggtcggttacgtttccggtttttaccgg

SEQ ID NO: 349690 - DNA, 635 bp, Homo sapiens
  misc_feature: GZ8MTXP02FQ1XN.45.37.D04.1.454.CMB.2.raw
  modified_base (247)..(247): a, c, t, g, unknown or other
  misc_feature (247)..(247): n is a, c, g, or t
  modified_base (255)..(255): a, c, t, g, unknown or other
  misc_feature (255)..(255): n is a, c, g, or t
  modified_base (283)..(283): a, c, t, g, unknown or other
  misc_feature (283)..(283): n is a, c, g, or t
  modified_base (363)..(363): a, c, t, g, unknown or other
  misc_feature (363)..(363): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtggaggagccgtgggcctcagtgagtctctgcaggctntggctacncctcaccggcgactatcctccacgtggngcgaccgacggcccctaggaccaagggcttgacgtggagtggatggactacaacccctaacagtggtcgacaacaaactncgacaacagtaacgttcgaaacggggcgtaagggtccaaccgtagacgacgaacggggacctaccgtaccaagtcaacggaccaaaccgacgtaccctaagtacgtacgggagtcctaagggacacgtaagtaccgtacggaaccgtacttccgtaacggaacccgaaccggtaaccggtaccctttaaattttaccgttaacgttggtacgaacggttacggtacgtttaccgggtttacggttacggtcgtttacgggttttttacccgg

SEQ ID NO: 349691 - DNA, 637 bp, Homo sapiens
  misc_feature: GZ8MTXP02FGFWN.45.37.D04.1.454.CMB.2.raw
  modified_base (182)..(182): a, c, t, g, unknown or other
  misc_feature (182)..(182): n is a, c, g, or t
  modified_base (191)..(191): a, c, t, g, unknown or other
  misc_feature (191)..(191): n is a, c, g, or t
  modified_base (226)..(226): a, c, t, g, unknown or other
  misc_feature (226)..(226): n is a, c, g, or t
  modified_base (369)..(369): a, c, t, g, unknown or other
  misc_feature (369)..(369): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtncagctggtncagtctggggctgaggtgaggaagcctggggcctnagtgaggtctcctgcagctctggctacacctcaccggcgactatctccacgtgggtgcgacgacggccccgtaggaccgaagggcttacggagtggacgtgggatggatccaaaccccctaacaagtggtcgacaacaaactnacgacaacgagtaatttcgaagggcacgggtccaacgagtacgaccgagggaccacgtaccgataccaaacgacacgaccctaacgacgtagggaacgtcgtaggaacgaccgaagtaaccgttagaacctaagtaccgtaaccggaaccgtaaccgtaaccgggtaccctaaagtttttaacgtaacgttacggtaccggaccgtaaagggtacgtttacggtttaaccccgggtgttacccggttacggttttccgttttaacggg

SEQ ID NO: 349692 - DNA, 606 bp, Homo sapiens
  misc_feature: GZ8MTXP02IY6I0.45.37.D04.1.454.CMB.2.raw
  modified_base (235)..(235): a, c, t, g, unknown or other
  misc_feature (235)..(235): n is a, c, g, or t
  modified_base (244)..(244): a, c, t, g, unknown or other
  misc_feature (244)..(244): n is a, c, g, or t
  modified_base (449)..(449): a, c, t, g, unknown or other
  misc_feature (449)..(449): n is a, c, g, or t
  modified_base (478)..(478): a, c, t, g, unknown or other
  misc_feature (478)..(478): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagcgtgggctgagtgagtctcngcaggctgngctacaccttcgaccggcactactctccgagtgggtgccgacgtacggcccctaggacgaagggcttaggacgtggagtgggaatcggaactaccgtaaacccccgtaaagaagttcgggtacggtacaaaactaaactcgtcgacaacgtaagtaaacgtttcggaaggtcgaaacgggtacaacgagtacgacgaacggaccncgacctagacacgcaacgtcactacgagngagtcgagacgagtagacctaggacctagtcaacgacgtaccgaccgtacttacttttacgtaactcggagtaacgggacgttaacggttacgggttaccggttcggttcgtttcgggtttttaaccg

SEQ ID NO: 349693 - DNA, 705 bp, Homo sapiens
  misc_feature: GZ8MTXP02FKJ3R.45.37.D04.1.454.CMB.2.raw
  modified_base (224)..(224): a, c, t, g, unknown or other
  misc_feature (224)..(224): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctnagtgaaggtctcctgcaaggtcttctggctacaccttcgaccggcgactatcctccacgtgggtgcgacacgggcccctggacgaaggctttggaggtggagtggggatacggactaaaccgaaccctaacgaagttcgggtacggaccaaactaaaactatgaccaacgtaaggttaacgtttacgacggggtacgaacggggttaccaaacgtacgtacggaaaccggacggggaaaccctacgtacccgtaaagtccaacggaccaaacaaccggtaccctaaacgacggtaggggaactcggtaacgaacggtaccaaggtaccgttaggaaccgagtttacccgaggaaacccgacggtaaaccggtaccctttaaagtttaaccgttacgtaaggtcggtaacgggtaaggttacgttttacggggtttacccggggtggtttacccggtttcggttttacccgttttaacgggg

SEQ ID NO: 349694 - DNA, 654 bp, Homo sapiens
  misc_feature: GZ8MTXP02IP633.45.37.D04.1.454.CMB.2.raw
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
  modified_base (512)..(512): a, c, t, g, unknown or other
  misc_feature (512)..(512): n is a, c, g, or t
tcagacgcgatcgacacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaagagcccactcccaggtgcagctggtgcagtcgtggggctgaggtgaggagccgtgggcctnagtgagtctctgcagtctntgctacaccttcgaccggcgactatcctaccacgtgggtcgcgacgacggtccccgtggaaccgaagggtcttaggaggtgggagtcggggatggacgtacctaaaccctaagaacgtggtacggacaactaaaacgtatcgacaacgtaaaggttaagtttaccgggaggggtacgaaggggttacccaaacgtacgtacgaaccggtaagggaaccctaccggtacccaagtccgaacgaccacgtaacgaccctaagagtacggntacgacgagacaacggtacgacaacgtactccgaggaccgacgtaccgacctttaaatttacgacgttaggtacgtcggaaggttacggtttcggtttaccggggttcgttacggttttcgggttttaccgttttacggggg

SEQ ID NO: 349695 - DNA, 646 bp, Homo sapiens
  misc_feature: GZ8MTXP02F26BW.45.37.D04.1.454.CMB.2.raw
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggagatcctcttcttggtggcagcagccacaagacgcccactcccaggtgcagctggtgcagtcgtgggctggaggtgaggagccgtgggcctgagtgacgtctctgacaggtcttcgngctacncctcgaccggctactactcctccgtacggtgggtcgacgacgaccggccccgtaggaacgagggtctaggaggtggagtgggatcggaactaccgaaaccctaacgagtcggacgactaaacgaacttgacacaacgtaagtacgttacgacgggcgtagggaccaacgtacgacgaacggacggacctaccgacacgacagtaccaacgaccgtcctaaaggagtacggacgtacgacgacgaacgtacgtactacgactacgtaccgtacgaccggtaccgtaaccgttacttaactttacgttacggtacggtacggtaaccgggttacgtttacgggtttaccggggttaccggtttcggtttaccggttttaccggtttaccggg

SEQ ID NO: 349696 - DNA, 637 bp, Homo sapiens
  misc_feature: GZ8MTXP02INIO8.45.37.D04.1.454.CMB.2.raw
  modified_base (247)..(247): a, c, t, g, unknown or other
  misc_feature (247)..(247): n is a, c, g, or t
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
  modified_base (493)..(493): a, c, t, g, unknown or other
  misc_feature (493)..(493): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggagcgtgggcctgagtgagtctcctgcaggctcgnggctacacctcgaccggcactatcctcacgtggtgcgacgacgcccgtggacgaggtctgagnggagnggatggactaccgaaacccctaacgtaagtggtacggacaaacgtaaaacttcgtaacaaactaaggtaaacgtttacgggaacgggtaccgtaacggggtaccaacgtaacgtacgaaccgacgggaacctacgtacacgtcgaagcaacacgacctaacgaggtacgagtaccganacggacaaacggtactacgaacctagtacgaacggtaccgaaaccgtaccggtaacccttaaagtttacgttacgtacggtacgaacgggtaagtagttacgggtttaccggtggttcccgtttacgggttttaccgtttcggg

SEQ ID NO: 349697 - DNA, 698 bp, Homo sapiens
  misc_feature: GZ8MTXP02GIRB5.45.37.D04.1.454.CMB.2.raw
  modified_base (294)..(294): a, c, t, g, unknown or other
  misc_feature (294)..(294): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcagtgaaggtctcctgcaaggcttcgtggctacaccttcgaccggcgactatcctcctacgtgggtnccgacgacggccccgtaggacgaagggtcttggagtggagtgggatggactaccgaacccctaaacgaagtcgggtacgacaaacctaaacttgacgaccgtaagaacggttaacgtttacccgaaggggtaccgtaaacgggggttcctaaacccgaagttaccggaaacccgtaacgggggaaaccctaccggttacccctaaaacgaccgaaacgaccgaaccgtaccgtaccctaacggtaggtacggacgtacgtacggacgtacgacgtacgtacgtacgtacgtaccggtacgaaccgtaccgtaccgtaaacttacgtttacgttacgtaggtacgtaacggtaacggtttacggtttacgggtttaccggtcggtttacgtttacggttttaccg

SEQ ID NO: 349698 - DNA, 607 bp, Homo sapiens
  misc_feature: GZ8MTXP02G95MJ.45.37.D04.1.454.CMB.2.raw
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (414)..(414): a, c, t, g, unknown or other
  misc_feature (414)..(414): n is a, c, g, or t
  modified_base (478)..(478): a, c, t, g, unknown or other
  misc_feature (478)..(478): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccaacaagagccccactccccgaggtgccagcgtggtgcagtcgtggggctggaggtggaggagcgtgggcctgagtgagtcnctgcaggcttgngctaccaccttcgaccggacgtactatcctccgacgtgggtcgacgaccgcggcccgtggacgaggtctggaggtggagtggggataggactacccaacccgtaaataagtgggtacgaactaaacaacttagacgacacgagtaagtttcgacgggngacggtcacgacgtacgacgaggccaccgtacatacgacgacacgacgactacgagtgggaacncgagagacgacgacgtagactacgtcggacgaaccgacgtacgtactttaactttacgtacggttacgtaacggtacgttaacgggttcgtttaacggggtttacggttcggtttaccgggttttacgg

SEQ ID NO: 349699 - DNA, 613 bp, Homo sapiens
  misc_feature: GZ8MTXP02J04HL.45.37.D04.1.454.CMB.2.raw
  modified_base (299)..(299): a, c, t, g, unknown or other
  misc_feature (299)..(299): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagccccactccccaggtgcagctggtgcagtctggggctgaggtgaggaagccgtggggcctcgagtgaaggtctccgtgcgaggtcttcgtggctacaccttcaccggcgactatcctccacgtgggtgcgacncggcccctggacaaggcttgagtggatgggatggatccaaacctacaagtggtgacaacaaactatgcacagtaagttcgagggcaggggtaccaccgatcgaaccgaagggtaccacggtcccaagtccaacgaccaacacgtcctaacgagtgggatccgaggacgcaacgtagtacgacgtactacgtacggaacgaccgaacggtacccttaaagttttacgtaaccttgggtacgtaccggtaaggtacgtttccgggttttaaccggggtcggttaccgttttacggggttttaccgtttttaacggg

SEQ ID NO: 349700 - DNA, 616 bp, Homo sapiens
  misc_feature: GZ8MTXP02FK0V2.45.37.D04.1.454.CMB.2.raw
  modified_base (371)..(371): a, c, t, g, unknown or other
  misc_feature (371)..(371): n is a, c, g, or t
  modified_base (457)..(457): a, c, t, g, unknown or other
  misc_feature (457)..(457): n is a, c, g, or t
  modified_base (476)..(476): a, c, t, g, unknown or other
  misc_feature (476)..(476): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctgagtgaaggtctccgtggaagcttcgtggctacaccttcaccggcgactatctccactgggtgcgacgacggcccctggacaacgggcttggagtggagtgggatgactcaacccctaacaagtggtacggcaacgtaaactntgacaacgaagtaagtttcgagggacgagggtcaccagtcgacgaggacgacgtcagtcacacacacgacctacgagtaggacgtnacgaacgcgaacggtacgnggaaaccctagttaccgacggaaccggaccgaacccgggttaccctaagttttaacgttaacgtcggttaggaaccggtaaggtacggtttacggtttaacccggggttcggttacccggtttcggtttttttaacccgg

SEQ ID NO: 349701 - DNA, 703 bp, Homo sapiens
  misc_feature: GZ8MTXP02JH0WJ.45.37.D04.1.454.CMB.2.raw
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggctgaggtgaggaagccgtggggcctcgagtgaaggtctcctgcaggtcttcgnggctacnccttcaccggcgactatcctccacgtgggtgcgacgacggcccctaggacgaaggcttggagtggagtgggataggactaccaaaccccctaacgagtggtacggaccaaacggaaaccttggtacgacccaaacgtacggttaaacggtttacgaacgggggtaccggtaaaccgggggttccaaacccgtacgttacgggaacccgtaaacgggggaaccctaacccggttccaaacgttccgaaacgggacccaaacggtaccgtacccgttaaacgacggttacgggacgggtaccctagggacacgttaaccgaacgttacgaactaacgtcgtaacggacccgaacgtaccggaccttaagttttacgtaccgtgtaccgaaggtaacggttacttacggggttaccggtcggttaccgttttcgggtttttacccg

SEQ ID NO: 349702 - DNA, 651 bp, Homo sapiens
  misc_feature: GZ8MTXP02H89RI.45.37.D04.1.454.CMB.2.raw
  modified_base (301)..(301): a, c, t, g, unknown or other
  misc_feature (301)..(301): n is a, c, g, or t
  modified_base (314)..(314): a, c, t, g, unknown or other
  misc_feature (314)..(314): n is a, c, g, or t
  modified_base (359)..(359): a, c, t, g, unknown or other
  misc_feature (359)..(359): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgttttagacagctccaacaataagaactacttagcttggtaccagcagaaaccaggtcagcctactaanctgctcatttacnggcatcctacccgggatccggggtcccctgaccgattcagtggcnggcgggtctgggacagtatttcactctcacctagtcagctagccctgccgaagggctaggaaaagtcgtggtcgggtaccttaaggtttttcttcggcgttacggttccgaagtacctaaatttactttaattaactttaaaccgtttcccgttccccgttaaacgtttttccccgggaacccccgtttacggggtaaaaccccgtaaaacggggtttaggtaaacgttaaaccttaaaacccgtaaaaaaccggttaaacgttccggttttaaggggaaccctttaccggg

SEQ ID NO: 349703 - DNA, 567 bp, Homo sapiens
  misc_feature: GZ8MTXP02JFXCI.45.37.D04.1.454.CMB.2.raw
  modified_base (347)..(347): a, c, t, g, unknown or other
  misc_feature (347)..(347): n is a, c, g, or t
  modified_base (368)..(368): a, c, t, g, unknown or other
  misc_feature (368)..(368): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggagcctggggcctcgagtgaaggtctcctgcaaggcttctggctacaccttcgaccggcgactatcctccgactgggtgccgacacggccccctggacaagggtcttgagtggagtgggatggatcaacccctanagtgtagcacaactgtgacanagtaagttcgagggcagggtcaacagtacgacgagggacaccgtccatcacgcaacgacgacctacgagtacggagtccgagacgacgtagactagacatcgacgacgacaccggtaccttaagtttacgttacgtgtcggtaacgtacggtaacgtttcgggtttaccggtcggttaccggtttcggtttttacccgg

SEQ ID NO: 349704 - DNA, 652 bp, Homo sapiens
  misc_feature: GZ8MTXP02JLOXY.45.37.D04.1.454.CMB.2.raw
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtggggcctgagtgaaggtctctgcaggcttcgtggctacaccttcgaccggcgactactcctaccacgtgggtcgacgacgccgggccccgtaggaccgaaggtcttaggacggtggagtgggatggaactacaaacctaaccgagtcggtagacaacgaaacttatcgacaaacggtaagtacgtttacgaacgggacgtacggggtccaaccgaagtaccgaacgaacgggaacctacgtaccaacgttaccgacgaccgaacgtacgaccgttaacgagtacggacgtacgaggacgagtacgacgacgacgtacgtacgacgaaccggtacgaccggtaccttaatttaaccgttagtacgggtacgacggtaaggttacggtttacggttacccggggtgttacgttttccgggtttcgtttaaccggggg

SEQ ID NO: 349705 - DNA, 604 bp, Homo sapiens
  misc_feature: GZ8MTXP02JSP0P.45.37.D04.1.454.CMB.2.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (385)..(385): a, c, t, g, unknown or other
  misc_feature (385)..(385): n is a, c, g, or t
  modified_base (449)..(449): a, c, t, g, unknown or other
  misc_feature (449)..(449): n is a, c, g, or t
  modified_base (546)..(546): a, c, t, g, unknown or other
  misc_feature (546)..(546): n is a, c, g, or t
tcagacgcgatcgacacgaccggtgctcgatttagtagcatactgttgtgtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctgaggtgaggagccgtggggcctnagtgaggtctcctgcaggcttcgnggctacaccttcgaccggcgactatcctccacgttggggtcgcgaccgacggcccccgtaggacgtaacggggtcttaggaggtggagtggggatggataccccaaacctaagagtgggtcgacaactaactntgaccaagagtagtttacgagggtcagggtacaccgagcgaacgaggaccacgtcagcacgacncgacgacctaacgagtacggagtcgtaggacgagacgacgtacggaacacgtacgacggacccgaacggaccggttaccttaatttaacgttaacgnggttaacggaccggtaaggttacggttacggtttaccggtcggttacgttttccgggg

SEQ ID NO: 349706 - DNA, 619 bp, Homo sapiens
  misc_feature: GZ8MTXP02GHH1X.45.37.D04.1.454.CMB.2.raw
tcagacgcgatcgacacgaccggtgctcgattttagtagcatactgttggggtttgggggcatcaccccagcaaccacatctgtcctctagagaatccccctgagagctccgttcctcaccatggactggacctggaggatcctcttcttggtggcagcagccacaagagccccactccccaggtgcagctggtgcagtcgtgggggctgaggtgaggaagccgtgggggcctcgaggtgaaggtcctcctgcaaggcttcgtggctacacccttcgaccggcgactatcctccacgtgggtgcgacacgggcccctggacgaagggcttggagtgggagtggggatggatcctaaaccctaacgaagtggtaggaccaacgaaacttatgacaacgaaggtaacgtttacgagggtcgacgggtacacagtcgacgaggaccgacgtccatcagacacacgcctaacgagtaggacgacgtgacgacaagactagactatcgtacgaaccgacgaccggaccttaatttaacgttaccgtaggtacgacgggtaacggttacgtttaacggtttaccgggttacggttccgtttacggttttccgtttttaaccgggg

SEQ ID NO: 349707 - DNA, 791 bp, Homo sapiens
  misc_feature: GZ8MTXP02G6ER2.45.37.D04.1.454.CMB.2.raw
  modified_base (260)..(260): a, c, t, g, unknown or other
  misc_feature (260)..(260): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccaacaagacgcccactcccaggtgcagctggtgcagtcgtggggctggaggtggaggaagccgtgggcctcgagtagaacggtctcgtgcgaaggtcttcgnggctacaccttcgaccggacgtactactcctaccgacgtcgggtcgaccgaacgaccggtcccccgtaggaacgtaacgggtcgttaggacggttagggaaggtacggggtagttacggggaacctaaacccgtaaaacccgttaaaccgtaaacggttcggggtacggaaacctaaccgtaaaaacgttacgtaccggaaacctaaaccggtaaaacggggtttaaaaccgttttaccggggaaacgggggaccgggttaaacgggggttaccccaaaaccggtaaacggttaccgggaaaaccccggggtaacggaaaacccgttaaccccgggtaaccctaaacgtaaccggaaccgaccccgtaaacgtacccggaaacccttaaaggagtaccggggacaccggtaagaacgaccgaaggtaccagtactacgtacgacgtacgaccgtacgtacttaatttacgacgtagtcgaagtaacggtagttaccggtttacggcgtcgtttccggtttacgttaccggg

SEQ ID NO: 349708 - DNA, 671 bp, Homo sapiens
  misc_feature: GZ8MTXP02J0JUN.45.37.D04.1.454.CMB.2.raw
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaggtctctgcaggctcnggctacncctcaccggcactatcctccacgtgggtgcgacgacggcccctggacgaagggcttggagtggagtgggatggataccaacccccgtaaacagtgggtcggtacaaaccgtaaactgtacgaccaagtaaggtaagtttcgaacggggtcgaacgggggttaccaccctagtacggacccggaacggggaacgaccggttaccctaaacgtccgaaacgaccgaaaccgacggtaccctaaacgtaacgtaggggtaacgcggttacgaacgacccggaaagacgtacggaactacgttaccgttacggacccggaaccgtaccggtacccttaattttacgtacgtaggtaggtaacgggtaagggtcgtttacggggtttacccgggtagggttccggtttacggttttccgg

SEQ ID NO: 349709 - DNA, 590 bp, Homo sapiens
  misc_feature: GZ8MTXP02F6AFL.45.37.D04.1.454.CMB.2.raw
  modified_base (264)..(264): a, c, t, g, unknown or other
  misc_feature (264)..(264): n is a, c, g, or t
  modified_base (285)..(285): a, c, t, g, unknown or other
  misc_feature (285)..(285): n is a, c, g, or t
  modified_base (391)..(391): a, c, t, g, unknown or other
  misc_feature (391)..(391): n is a, c, g, or t
  modified_base (455)..(455): a, c, t, g, unknown or other
  misc_feature (455)..(455): n is a, c, g, or t
  modified_base (486)..(486): a, c, t, g, unknown or other
  misc_feature (486)..(486): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaaggtctcctgcaaggtcttcgtggctaacnccttcgaccggcgactatccnccgacgtggtgcgacacggcccctggaacgaagggtcttggagtggagtgggataggactaccgaaaccccctaaacgaagtgggtacggacaacctaaaacgttncgacaacgaagtagtttaccgagggtcgagggtacaactagacgacgaggacacgtacagccancaacacgcctaacagtggaacgtgagacganacgatcgaacgactcgtacgaacggacacggtaccttaatttacgtacgtggacgtaaggtaggtacgttcgggttaccggtcggtaccgtttcggttttaccg

SEQ ID NO: 349710 - DNA, 574 bp, Homo sapiens
  misc_feature: GZ8MTXP02GKOR7.45.37.D04.1.454.CMB.2.raw
  modified_base (258)..(258): a, c, t, g, unknown or other
  misc_feature (258)..(258): n is a, c, g, or t
  modified_base (377)..(377): a, c, t, g, unknown or other
  misc_feature (377)..(377): n is a, c, g, or t
  modified_base (481)..(481): a, c, t, g, unknown or other
  misc_feature (481)..(481): n is a, c, g, or t
  modified_base (527)..(527): a, c, t, g, unknown or other
  misc_feature (527)..(527): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtggggcctcagtgaaggtctcctgcaggcttcgtggctacnccttcgaccggcgactatcctccacgtgggtcgcgacgccggccccgtggacgaagggtcttggagtggagtgggatggactaccaaacccctaacgaagtggtacgacaacaaacgtntcgacaacgtagtaacgtttcgagggctagggtcaccgatacggacgacgggacaccgtacactcagcactacgcctacgagtcgggactcgagacgacagacngaccatcgacgacgacgaccgtactatttacgtacgtggttaccgnggtaaggttcgttcggtttaccggtgtccgtttaggtttttacccgg

SEQ ID NO: 349711 - DNA, 710 bp, Homo sapiens
  misc_feature: GZ8MTXP02JW6V6.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtggaaggaacgtccggtcggggcctcgaggtaggtaacggtcctcctgacgaaggtccttcgcggcctaccacccttaccgaccggctacttactcctaccgtacggttcggggtacgaccgtaaccggacccgggtcccccggtaagggaaccgtaaaggggtcgttaggacgggtagggtagtcggggagtacggactaacccgtaaaccccgtaacgaaggtcgggtacgaaccaaaacgtaaacttgacgaactacgtaaaggttagttaccgggaggtacggtacgaccaaacgtgaacggaccggaagaccctaccgactacgtcacgaccaacgacctaacctagtagacgggagacgtgaaccggacaacgggtactcggaaactcgttacggaacggtaacccgaacgtaccgttaacgtttaagtttaacgcgttaggtacggaagtagttacgttcgggttacggtcggtttcgtttccggttttacgg

SEQ ID NO: 349712 - DNA, 608 bp, Homo sapiens
  misc_feature: GZ8MTXP02ISGNS.45.37.D04.1.454.CMB.2.raw
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggctgaggtgaggagccgtgggctcagtgaggtctctgcagcttcnggctacnccttcaccggcgactatcctccactgggtgcgacgacggcccctggacagggcttggagtggagtgggatggaataccgaaaccccctaacgaagtcgggtacggacaaaccaaaactgtagaccaacgagtaacggtttcgagggggacaggggtccaaccgatacggaccgaagggacaccggtccatacgacgacacacgcctaacagtacggagcgtacggagcgaagacgtacgaacgtacgtaccgtacgaaccgaccgaccggtacctaacgttttacttaacgtcggtacgtaaccggtaaggtacgtttacgggtttaccggtcggttcgttttacggtttttcccgg

SEQ ID NO: 349713 - DNA, 670 bp, Homo sapiens
  misc_feature: GZ8MTXP02GST0H.45.37.D04.1.454.CMB.2.raw
  modified_base (253)..(253): a, c, t, g, unknown or other
  misc_feature (253)..(253): n is a, c, g, or t
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
  modified_base (538)..(538): a, c, t, g, unknown or other
  misc_feature (538)..(538): n is a, c, g, or t
  modified_base (559)..(559): a, c, t, g, unknown or other
  misc_feature (559)..(559): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagcgtggggcctcgagtgaaggtctcctgcaggcttcnggctacaccttcacggcgactntctcacgtggtgcgacgacggcccgngacgaggtcgtgaggtggacgtgggtagtacggtacgtaaccgtaaacccccgtaaccgaagttcgggtacggaccgtaaacaaaacgttagtacgacgaacgtaaacgtaacggtttacgacgggggaccgtacggggtaacctacccgtaagtacgaaccggaccggtaacgtaccgtaccgtaactcgacgacgaaccgacgtacccgtaacgtacgaggtacggtccgtaagngtacgacgtaagtacgacgtntaccgtacgacggtaacccacgggttaacctacttttacgaaccttcgggtagtaaccggtaagttacgttaccgggtttacggtcggtttaccgtttacggttttcccgg

SEQ ID NO: 349714 - DNA, 651 bp, Homo sapiens
  misc_feature: GZ8MTXP02HB2PD.45.37.D04.1.454.CMB.2.raw
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (469)..(469): a, c, t, g, unknown or other
  misc_feature (469)..(469): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcaggtcttgnggctacnccttcaccggcactactctccgacgtgggtcgcgtacgacggccccgtaggacgaagggtcttaggaggtagggagtggggatcgggaactaccgaaacccgtaagaagttcggggacgactaaacgtaaaacttgtcgacctaagacggttaacgttcgaaggggacgtacgggtaccacgagtacgaccgaagggactacgtcgaanccgagacctagacgtactacgagtacgagtcgtagaacgcgaacgacgtagaacctgttacgacggtaaaccgaccgtaccggtaccttaagtttaaccgttccggtagtacggtacggaacggttacgtttacggggtttaccggtacggtttacctttaacggtttcccgtttaacgggg

SEQ ID NO: 349715 - DNA, 617 bp, Homo sapiens
  misc_feature: GZ8MTXP02HW50B.45.37.D04.1.454.CMB.2.raw
  modified_base (250)..(250): a, c, t, g, unknown or other
  misc_feature (250)..(250): n is a, c, g, or t
  modified_base (274)..(274): a, c, t, g, unknown or other
  misc_feature (274)..(274): n is a, c, g, or t
  modified_base (286)..(286): a, c, t, g, unknown or other
  misc_feature (286)..(286): n is a, c, g, or t
  modified_base (332)..(332): a, c, t, g, unknown or other
  misc_feature (332)..(332): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctggaggtggaggagccgtgggcctgagtgaaggtctcgtgcagcttnggctacaccttcaccggcgactanctccacgttggngcgacgacggcccctaggaacgtaggctggagtggatgggatgganaccaaacccctaaacaagtggtggacaaacaaactatcgacaacgtaagtaagtttcgagggtcgaagtcccgaacgactacggaacgaggaccgtacgtacaactacagacacgacgacctaagagtacgaagcgagacacgaacgaccaggtaacaacgttcgacggacgaaccgtaccggaactttaaacgtttaaccgttaccgttaggtacgtaaccggtaaggggtacgtttccggggtttaaacggtcggttaccgttttacgggtttttaacccggg

SEQ ID NO: 349716 - DNA, 613 bp, Homo sapiens
  misc_feature: GZ8MTXP02HNYYH.45.37.D04.1.454.CMB.2.raw
  modified_base (184)..(184): a, c, t, g, unknown or other
  misc_feature (184)..(184): n is a, c, g, or t
  modified_base (245)..(245): a, c, t, g, unknown or other
  misc_feature (245)..(245): n is a, c, g, or t
  modified_base (333)..(333): a, c, t, g, unknown or other
  misc_feature (333)..(333): n is a, c, g, or t
  modified_base (426)..(426): a, c, t, g, unknown or other
  misc_feature (426)..(426): n is a, c, g, or t
  modified_base (460)..(460): a, c, t, g, unknown or other
  misc_feature (460)..(460): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtncagctggtgcagtcgtggggctgaggtgaggagccgtgggctcagtgagtctctgcagctngctacacctcacgcgactatctcacgtggtgcgactacggccctaggacaagggtctgagtggatgggatggatacccaaaccgtaanagtggtggaccaacaactatacgacaaagaagtacgtttacgaacggggcgtacgggtcaaaccagtacggaaccgagggaccaacgtaccanacgacacaacgacacccttagcgtaggagaccgngacgacgaacgttactacggactaacgtcgtaacgaaccggaaaccgaacccgggtaccttaactttaaacgtttacgttaccggtaaggtaaccggagggttaaacggtttcgggtttaacccgggttcgggtttaccgttttttcccgggg

SEQ ID NO: 349717 - DNA, 600 bp, Homo sapiens
  misc_feature: GZ8MTXP02GFR2F.45.37.D04.1.454.CMB.2.raw
  modified_base (290)..(290): a, c, t, g, unknown or other
  misc_feature (290)..(290): n is a, c, g, or t
  modified_base (456)..(456): a, c, t, g, unknown or other
  misc_feature (456)..(456): n is a, c, g, or t
tcagacgcgatcgacacgaccggtgctcgatttagtagcatactgttggggtttgggggcatcacccagcaaccacatctgtcctctagagaatccccctgagagctccgttcctcaccatggactggacctggaggatcctcttcttggtggcagcagccacaagagcccactcccaggtgcagctggtgcagtctggggctgaggtgaggagccgtggggcctcagtgaggtctcctgcaaggcttcgtggctacaccttcaccggcgactatcctccacgtggggtncgtacacggccccctaggacaaggggtcttggagtggatggggactggactacaaaccctaagaagtggtagacaacgaaaactgtcgacaacgtaggtaaacgtttcgaaacggggtcaacggggtaccaaccgagtacgaaccgagggaccacgtccaatcganacacagacctacgagtggacgcgtagacgacaggacgtaacactacgtcgacgaccgacgtaccgtacttaactttacgtacgtacgtacgacggtaaggttacgttacggttaccggtcgttcgtttcggtttacgtttacgg

SEQ ID NO: 349718 - DNA, 657 bp, Homo sapiens
  misc_feature: GZ8MTXP02FMBRP.45.37.D04.1.454.CMB.2.raw
  modified_base (277)..(277): a, c, t, g, unknown or other
  misc_feature (277)..(277): n is a, c, g, or t
  modified_base (490)..(490): a, c, t, g, unknown or other
  misc_feature (490)..(490): n is a, c, g, or t
  modified_base (530)..(530): a, c, t, g, unknown or other
  misc_feature (530)..(530): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcgagtcgtgggctggaggtgaggagctgggcctcagtgaggtctctgacaggcttcgtggctactacctcgaccggcgactatccncctacgtgggtgcgacgacggcccccgtaggaaccgaagggtccttggaggtcggagtcggggatggactaccaaacccccgtaaacaagttgggacggactaaaccgaaactagtacgacgtaacgaagtaacgtttcgacgggggtactaacgggggtacctaaacccgataccgggtaaccgaacgggaccacccgttaccgataccganaccaacacgaccctaacgagtacgggataccgtagaacgngaacggacttacggaacctagtccgtacgaaaccggtaccaccgggtacttacgtttaaagttcggtagtacggtaaggaggttacgttaacgggtttcggtcggttccgtttaacggtttttccgg

SEQ ID NO: 349719 - DNA, 688 bp, Homo sapiens
  misc_feature: GZ8MTXP02JM4L8.45.37.D04.1.454.CMB.2.raw
  modified_base (244)..(244): a, c, t, g, unknown or other
  misc_feature (244)..(244): n is a, c, g, or t
  modified_base (478)..(478): a, c, t, g, unknown or other
  misc_feature (478)..(478): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgccagctggtgcagtcgtgggctggagggtgaggaagccgtggggcctcagtgaggtctccngcgaggtcttcgtggctacctaccttccaccggcgactactctccacgtggtgcgacgaccggcccgtggacgaaggctggagtggagtgggatggataccaacccccgtaacgaagtggtacggcaaactaacactgaacaacgttagtaaagtttcgacgggtacgacgggttacaaccgagtaccggaaccgacggggaaccacccggttacacgtaccaaggacccaaanacccgtacccgttaaacggacggtacgggaccggtacgacggtacgacgtacgtaacgtacgtaaccgtacgtaaccgtaaccggacccgtaaccggtaacccgttaacgtttaaacgtttacgttacggttacggtacggtaacggtacgggttaccggttttaccggggttaccggtttccggtttaccggttttacggttttaccgg

SEQ ID NO: 349720 - DNA, 533 bp, Homo sapiens
  misc_feature: GZ8MTXP02JPDRC.45.37.D04.1.454.CMB.2.raw
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (402)..(402): a, c, t, g, unknown or other
  misc_feature (402)..(402): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (443)..(443): a, c, t, g, unknown or other
  misc_feature (443)..(443): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctgaggtgaggagcgtgggctnagtgagtctctgcgagcttcngctacnctcncgcacntcncacgtggtgaccgcgacggccctggaacgaggcttgagtgagtggatggactacaacccctagaagtggagacaacaactgtcgacgacgagtacgttacgaggacgtaaggcacgtagacgacgaggaccacgtcacncagcactcgaccagagngancgngacncgtagacgcgaacncgtacgacgacgtaccgtacgtaacttacgttacgtcgtgtacggtaagtacggttacgtttcggtacggttcgttacggtttcgtttcg

SEQ ID NO: 349721 - DNA, 619 bp, Homo sapiens
  misc_feature: GZ8MTXP02I0O36.45.37.D04.1.454.CMB.2.raw
tcagacgcgatcgacacgaccggtgctcgatttagtagcatactgttgggtttgggggagctaaaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctaccaaacaataaagaactacttagcttaggtaccagcaagaaaccaggtacagcctacctaaagctgctactatttactgggacactaccgtaaccccgggaatcccggggtccctcgaccgtattcgaggtggacaggtcggggtctaggggactagtatttcacttctcaaccatacagacagcctgcagggactagaaagtaatgggtaggtacttaggttttaattggtctgtacaagtactaaattaatttaattattacgtttaccctaccgtaccgtttccggtaccccgttagggtaacccgtaaaacggtcggaaattaacgtaaacgtaaaacggtaaaccttaggtacggtactacggtaaccc

SEQ ID NO: 349722 - DNA, 718 bp, Homo sapiens
  misc_feature: GZ8MTXP02JQNML.45.37.D04.1.454.CMB.2.raw
  modified_base (250)..(250): a, c, t, g, unknown or other
  misc_feature (250)..(250): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcgagtcgtgggctggaggtgaggagccgtgggctgagtgaggtctctgcaggcttcgnggctacaccttcgaccggcgactatcctcctacgtgggtcgcgaccgacggtcccccgtgggaaccgaaggggtcttaggaggtagggtagtaggggataggaactacccgtaaaacccccgtaaacgtaaggtacggggtacggaaccaaaaccgtaaaacttgtacgaaccaaacgtaaagtaacgtttacggaacggggtaccgaaggggttacccaaaccgtaagtacggaaacccggaacggggaacccaccggttacccaacgttaccgaaacgaccgtaaacccgaaccggtaccctaaacggtacggttacgggaaccgtcgtaacgacggaacgtaacggaactacgaactacgttacggacgaaccggaaccgtaccggtaaccttaagtttacgtacgtcggtagaaccggtagtacgtttcggttaccggtcggttaccgtttcggtttttaccgg

SEQ ID NO: 349723 - DNA, 700 bp, Homo sapiens
  misc_feature: GZ8MTXP02HJNVG.45.37.D04.1.454.CMB.2.raw
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcagtgaaggtctctgcaggtcttcgtggctacacccttcgaccggcgtactactcctcctacgtgggtcgcgaccgacggccccgtaggaccgaaggtcgttaggaggtgggagtgggatggactaccaacctaacgaagtggtacggacaacgtaaactagtcgaccaacgtaacggttaaacggtttacggacggggaccgtacgggggtacccaaccgtaagtacggaacccgaaacggggaacccaccggttacccaacgtacccgaacgacccgaaccgaccggtacccttaaacgacggttaggacggttaccgagacggacccgaaggtacgtacgaacgtacgtacgtacggaaaccgtaccgacccggtacctttaagtttacgttacgtcgtacggtacggtaaggttacggtttacgggtttaccgggtcggtttccggtttccggtttttaccgtttaccggg

SEQ ID NO: 349724 - DNA, 621 bp, Homo sapiens
  misc_feature: GZ8MTXP02H33O1.45.37.D04.1.454.CMB.2.raw
  modified_base (245)..(245): a, c, t, g, unknown or other
  misc_feature (245)..(245): n is a, c, g, or t
  modified_base (254)..(254): a, c, t, g, unknown or other
  misc_feature (254)..(254): n is a, c, g, or t
  modified_base (277)..(277): a, c, t, g, unknown or other
  misc_feature (277)..(277): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcattcgtgggctggaggtgaggaagccgtggggcctcgagtgaggtctcctgnaaggcttcnggctacaccttcaccggcgactntactccacgtgggtgcgacgacggcccctggaacaagggcttggagtggagtgggatggactacgaaacccctaacaagtcggtaggacaaactaatctaggcaactagaaagtttcgagggcaggccacatacgacgagggacacgtccatcgagcaacgacgactacaagtcggagctagagacgacgtacgtcgaactacgtcgttacggaaaccggacgaaaccggtaccccgttaaaacgtttttattaaacccgtttggtacgaacggggtaaaggttacgtttacggggtttaaccccggggtttgggtaaccggtttttcgggtttttaaccccgg

SEQ ID NO: 349725 - DNA, 583 bp, Homo sapiens
  misc_feature: GZ8MTXP02FNM6Y.45.37.D04.1.454.CMB.2.raw
  modified_base (255)..(255): a, c, t, g, unknown or other
  misc_feature (255)..(255): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
  modified_base (402)..(402): a, c, t, g, unknown or other
  misc_feature (402)..(402): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
  modified_base (463)..(463): a, c, t, g, unknown or other
  misc_feature (463)..(463): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggagccgtggggcctcagtgaggtctctgcaggcttctggctacnccttcaccggcgactatcctccacgtgggtgcgacgcggccccgtggaccgaagggtccttggaggtggagtgggatggataccaacccctaacagtggngacaacaaactnagcaacgtagtaagtttcgagggtcgaggtacacngtacgacgtaggacacgtctancagctancgacagntggagagtcgagcgaagactcgacnctacgtacgaccgacgtaccgtacgttaaactttacgttaaccgtggttacggtaacggtacggtaacgtttacgggggtttaccgggtacggtttccggtttacgggttttttacccgg

SEQ ID NO: 349726 - DNA, 662 bp, Homo sapiens
  misc_feature: GZ8MTXP02GD406.45.37.D04.1.454.CMB.2.raw
  modified_base (250)..(250): a, c, t, g, unknown or other
  misc_feature (250)..(250): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctgctgcagtcgtggggctgaggtgaggagcgtgggcctcagtgaggtctctgcgaggtcttcgnggcctacacctcgaccggcactctctccacgtggtgcgacgcgcccgtggacgagggtctgaggtggtagtgggatggactaccccaaacctaagagtcggtacgacaaactaacgtagtacgacgtagtacgttaaacggttcggaaggggtccgaacggtacccgaacgacgtacggaaccgtaacgggacctaacccggtacacgtaccgaacgaccgaaccgaaccgtcccgtaaacgaggtaccgggacgtacggtagaacgggacaaacgtcgtacgaactacgttcgaaacggaaccgaacccggtaaaccggtactttaacggttttacttacggtacgttaacggtccggtaaaggttaccgtttacggggtttacccggggtggtttaccgtttttccgggg

SEQ ID NO: 349727 - DNA, 634 bp, Homo sapiens
  misc_feature: GZ8MTXP02HT7OE.45.37.D04.1.454.CMB.2.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgacccagtcctccagacctccctggctgtgtctcgtgggcgagagggccaccatcaatgacaagccagccagtagttgtttagacagcctacaaacaataagaactactagcttagtaaccagacaacgaaaccagtacacgcctacctaacgctagctactatttacgtggactacgtaccgtaacccgggtacgtccccggggtcccctacgaccgtacttacgaggtcggacgcggggtcggtacgtagggaccagttacttactacctctacgaccctaatccgacgtccgaacgtccgtagaccgaagggtactaggaaagttcgtggtacggtacgttagtttactcgacgttagtacgaagtacttaaatttaattacgtttactaacttcccgttacgtaccgttccggaccgttacggaaccgtaagtagtaaactacgtaaacgtaacgtactcgtcgtactacg

SEQ ID NO: 349728 - DNA, 513 bp, Homo sapiens
  misc_feature: GZ8MTXP02FGPUM.45.37.D04.1.454.CMB.2.raw
tcagacgcgatcgacacgaccggtgctcgatttagtagcatactgttggggtttgggggcatcaccccagcaaccatatctgtcctctagagaatccccctgagagctccgttcctcaccatggactggacctggaggatcctcttcttggtggcagcagccacaagagccccactccccaggtgcagctggtgcagtctgggggctgaggtgaggaagctggggcctcagtgaaggtctcctgcaaggctctggctacaccttcaccggcgactatctccactgggtgcgacaggccccctggacaaggggcttgagtggatggggatggatcaaaccctaaccaatggtggcacaaaactatgcaacagaagtttcagggcagggtcaccatgacagggacacgtccatcagcacagcctacatggagctgagcagactgacatctgacgacacggccatttactactgtgcgaaggattcggttaccggtggtctgggttccttttacgg

SEQ ID NO: 349729 - DNA, 706 bp, Homo sapiens
  misc_feature: GZ8MTXP02IU0EK.45.37.D04.1.454.CMB.2.raw
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (324)..(324): a, c, t, g, unknown or other
  misc_feature (324)..(324): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagcgtggtgcgagtcgtggggctggaggtggaggagcgtggggcctcgagtgaggtctctgcagcttcnggctacnccttcaccggcgactactctccacgtggtgcgacgacggccccgtggaacgtaaggggtcttggnggtaggtagtggggtatgggaactaccgaaacccccctaaacgaacgttgggtacggaactaaaccaaaacgttgtacggaaccaaacgtaaggtaacgtttacgaacgggggtccggtaacgggtaccaacggttacgaaccgaaccgggaacgggtaacccgtacccgtaacgtaaccgtaccgaccgaaccgtaaaccggaacctaccggaaaccgtagggacgggtaccggacgtacggacgaacgcgtaacgacggtatacgtacgtaacgacgtaaccgccggttaactttaagttcgttaacgttcggacggtaaggtacggttaacggttaccgggtttcggttcggtttacggtttacggttttttaacccgg

SEQ ID NO: 349730 - DNA, 753 bp, Homo sapiens
  misc_feature: GZ8MTXP02JWCAO.45.37.D04.1.454.CMB.2.raw
  modified_base (253)..(253): a, c, t, g, unknown or other
  misc_feature (253)..(253): n is a, c, g, or t
  modified_base (329)..(329): a, c, t, g, unknown or other
  misc_feature (329)..(329): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcaggtctggggctggaggtgaggaagccgtggggcctgagtgaggtctcctgcaggcttcgnggctacaccttcaccggcgactacgtctccacgtggtgcgacgacggccccgtggacgaagggtcttggagtaggngtagggagtaggactaccgaaacccccctaacgaaacgtgggtacggacgtaaaccaaactacgtcgaccgtaaccgtagtaaacgtttacggacggggaccgtaggggtaccaaaccgtacgttacggacccgaaggggtacacccgtaccgaacgtccgagacccgaacacggtacctaacgtaacgttgggaacggtacgtacggaacggacccgaacgtaaccgttgggaaaacccttcgaaccggttaccggaaacccggaaaccggtaccccggggtaccccgtttaaatttttaaaaccgttacccggtttgggttaacggtaaccggggttaaacggtttaaacggttttccgggggttttaaaccccgggtttcggggtttaaccggttttccggttttttttaacccccggggg

SEQ ID NO: 349731 - DNA, 698 bp, Homo sapiens
  misc_feature: GZ8MTXP02F1Z13.45.37.D04.1.454.CMB.2.raw
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagcgtgggcctnagtgaggtctctgcaggcttcgnggctaccaccttcgaccggcgactactcctccgacgtgggtgaccgacgccggcccctaggacgaagggtccttggaggtggagtgggatggactacaaccccctaagagtggtcgacaacaaactgacacaacgtaagtacgtttacgaggggcgaacgggtaccaaccgagtacggaaaccgaacggggaacccacccggttaccaacggtaccaaacgaccaaaccgacgtaccctaacgtacggtacgggaacggtactacggaacggacctaacggtacgtacgaacgtacgttaccggaacggaacccggtaaccgtacccggtaacctttaaagttttaacgttaccggtacggttacggtaacggtaacgggtttacggtttaccgggggtttaccgggtttacgggttccccggtttttacggggttttttaaccccgg

SEQ ID NO: 349732 - DNA, 733 bp, Homo sapiens
  misc_feature: GZ8MTXP02FFSP5.45.37.D04.1.454.CMB.2.raw
  modified_base (348)..(348): a, c, t, g, unknown or other
  misc_feature (348)..(348): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctgagtgaaggtctcctgcaaggcttctggctacaccttcaccggcgactatcctccacgtgggtgcgacacggcccctggacgaagggcttgagtggagtgggatggatcaaaccccctaanaagtggtacggacaacaaacgtatgaccaagaagtaaacgttttacgaggggtacgaacggggtccaaaccgacgtacggaacccgaaggggaaccgaccggttacccaacgttaccgaacgcccaaaccgaccggacccctttaaaccgaagtagggtaaacgggtcgttacgggaacgacccgaaaggtaccgttaaggaacctaacgtttaccggtacggtaaacccgggaaaccgtaaacccggggaaccctttaaaacgttttacgttttaaaacccgtgggtttacgggaacccggttaaacgggggttaaagtttaccgggggtttttaacccggggtacgggtttccggttttaccgggggtttttttacccccggg

SEQ ID NO: 349733 - DNA, 558 bp, Homo sapiens
  misc_feature: GZ8MTXP02FLVOY.45.37.D04.1.454.CMB.2.raw
  modified_base (353)..(353): a, c, t, g, unknown or other
  misc_feature (353)..(353): n is a, c, g, or t
  modified_base (408)..(408): a, c, t, g, unknown or other
  misc_feature (408)..(408): n is a, c, g, or t
  modified_base (432)..(432): a, c, t, g, unknown or other
  misc_feature (432)..(432): n is a, c, g, or t
  modified_base (441)..(441): a, c, t, g, unknown or other
  misc_feature (441)..(441): n is a, c, g, or t
tcagacgcgatcgacacgaccggtgctcgatttagtagcatactggttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcgagtgaaggtctcctgcaaggcttctggctacgaccttcaccggcgactatctccgactgggtgcgacgacggcccctggacgaagggcttgacggtggagtgggagtggataccaaccccgtaanaacgtgtaggcaacaaactatcgacacagtaagtttcgagggtcaggggtcacangacgagggacacgctagcagacanacgactacngtagagctagaacgcgagtactgacattcgtacgacgacgaccgggtactactttaacgttacgtcggtacgcggaagtcgttacggtttaccggtcggtacgtttacggttttccg

SEQ ID NO: 349734 - DNA, 645 bp, Homo sapiens
  misc_feature: GZ8MTXP02HO7GY.45.37.D04.1.454.CMB.2.raw
  modified_base (298)..(298): a, c, t, g, unknown or other
  misc_feature (298)..(298): n is a, c, g, or t
  modified_base (609)..(609): a, c, t, g, unknown or other
  misc_feature (609)..(609): n is a, c, g, or t
  modified_base (624)..(624): a, c, t, g, unknown or other
  misc_feature (624)..(624): n is a, c, g, or t
tcagacgcgatcgacacgaccggtgctcgatttagtagcatactgttgggtttgggggagagcatcacccagcaaccacatctgtcctctagagaatccccctgagagctccgttcctcaccatggactggacctggaggatcctcttcttggtgcagcagccacaagagcccacctcccaggtgcagctggtgcagtctggggctggaggtggaggaagccgtggggcctcgagtgaaggtctctgacaggtctcgtgctacctacctcaccggcgactactcctccacgtgggtcnccgacgaccggccccgtaggaacgtaacgggtcgttaggacggtggagtagggtagtcggactacccgaaaccctaacgtaagtcggtcggtaccaacgtaactacgtagaaccaacgtaaaggttaacgttacggaacggggtacgacgggtacccacgtaacgccggaaccggaacggggtacccaccggtaccaagtaccgaacgacctaaccggactaccccgtaagtagtcgggaaactccggtagaacgcgtagacgtacgactacgtcgtacgaaccgcgtacgtaccttagttactacggttncggtgaagtttacgnggtttacgcgttcgtttacgg

SEQ ID NO: 349735 - DNA, 647 bp, Homo sapiens
  misc_feature: GZ8MTXP02I3VWA.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtcgtggggctgaggtgaggaagccgtgggcctcagtgaaggtctctgcaggcttctggctacaccttcaccggcgactatcctccgacgtgggtcgcgacgacggcccctggaaccgaagggtcttggacggtggacgtgggatggactaccaaacccccgtaacgaagttgggtacggacaaaccgtaaactgtacgaccaaacgtaagttaacggttacgaggggacgtagggtacaacgactacggaccgtagggacctaccgtacacgtacgacgaccacgacgtcctaacgagtacgggaacgtcgaagggacacggacgacgttaacgacctagttccgaacgaccgaaaccgtccggtaaccttaagttttacgttaaccgtggtacggtaaccgtaggtacgttttaccggttacggttcggttcgttttacggtttttaccgg

SEQ ID NO: 349736 - DNA, 696 bp, Homo sapiens
  misc_feature: GZ8MTXP02GBPDM.45.37.D04.1.454.CMB.2.raw
  modified_base (227)..(227): a, c, t, g, unknown or other
  misc_feature (227)..(227): n is a, c, g, or t
  modified_base (662)..(662): a, c, t, g, unknown or other
  misc_feature (662)..(662): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctggaggtgaggagccgtgggcctnagtgagtctcgtgcagtctcgtggctacaccttcgaccggcgactactcctccacgtgggtgcgacgaccggccccgtagggaacgaaggggtcttacggagggtcgggtaggtggggtaacgtcggggaactaccaaaaccccgtaaacgaaggttcggggtacggaacctaaacgtaaactacggtacgacgtaaacgtaaggttaaaccggtttacggaaacgggggtacggtaaacgggggtaccctaaaccggtaacgttaaccggaacccgggaaacggggtaacccgaaccggttacccaacgtaccgaaccgaccgaaaccgtaccgtaacctaaccgtagtacgggacgtacgacggacgtacgacgtacgtacgaactcgtacgtacggaccgacgtacggtactaatttaccgtagtcgtacgngtagtacgttcggtacgtgtcgtttcgtttaccg

SEQ ID NO: 349737 - DNA, 593 bp, Homo sapiens
  misc_feature: GZ8MTXP02JE2V8.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcgagtgaaggtctcctgcaggcttctggctacaccttcaccggcgactatcctccacgtgggtgccgacgacggcccctggacgaagggtcttggagtggagtgggatggactcaacccccgtaacaagtggtacggacaacgaaaactgtacgcaacgtaagtaagtttacgagggtccgagggtcaacccagtacgaccgaagggacaccgtaccatcacgcacacgacctacagtggatcgagagacgaagactgaacatctacgacgacaccgggtacctaagtttacgttacgtggtaggtaaccggtaaggttacgtttacgggtttaccgggtcggttaccgtttacggtttttcccgg

SEQ ID NO: 349738 - DNA, 622 bp, Homo sapiens
  misc_feature: GZ8MTXP02F1KMQ.45.37.D04.1.454.CMB.2.raw
  modified_base (298)..(298): a, c, t, g, unknown or other
  misc_feature (298)..(298): n is a, c, g, or t
  modified_base (382)..(382): a, c, t, g, unknown or other
  misc_feature (382)..(382): n is a, c, g, or t
  modified_base (431)..(431): a, c, t, g, unknown or other
  misc_feature (431)..(431): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactcctgggctgtgtctcgtgggcgagagggccaccatcaactgacaagtccagccagagttgtttagacagacaccaaacaataaagaactactagctaggtacagacaagaaaccaggtacacncctctaaagctgctctaatttacgtggactagtaccgtacccggtaaagtcccggggtcccctagaccgattcgaacggtcgcnggggacggtgtacggggtaacagtaatttcaacttccgacaaccctaanaccgagtacacgtccgtacgacgagtataaggaaagtagtggtacggtacttagtttacgtgacgtgtacagtaacttaattaagtttacttacgtactttcccgtacgttacgttaccggaccgttacgggaaaacctaaggtaactaacgtaaacgtaaacgaaaacgtcggtgttaccggacttaccg

SEQ ID NO: 349739 - DNA, 825 bp, Homo sapiens
  misc_feature: GZ8MTXP02H702F.45.37.D04.1.454.CMB.2.raw
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccgaggtgcagcgtggtgcagtcgtgggctgaggtgaggaagccgtgggcctcgagtgaagtctcgtgacgaaggtcttcgtggtacctacctacccttaccgaccgggcgtaactactcctccacggtagggtcgccgaaccgacggtcccccgtagggaacgaacggggtcttaggacggtgggtaagtggggtaagtacgggaactaacccgtaaaaccccccgtaaacgtaaacggttgggtacggtaaccaaaaccttaaaaccgtagtaccgaaaccgtaaacgtaaacggttaaacgtttacggaaacgggtaccggtaaaccggggtaaccgaaacccgtaacgtaaccgggaaaccccgggaaacggggtaaccccaacccgggttaaccaacgtaaccgaccggaccaaaccgtacgtaacccgttaacgaggtaacgggaaccgtaccgtaggaaacgaccgaacggtaacgtaacgaaccgtaacgttaccggtacgaacccggtaaaccgaaaccccggtttaactttaaacttttaaacgtacggtttcggaccggtaaggttacccgggttaaagttttacggggtttaacccggggtttcggtttaccggtttttaccggttttttaacccggg

SEQ ID NO: 349740 - DNA, 705 bp, Homo sapiens
  misc_feature: GZ8MTXP02HILCD.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcgagtgaaggtctccgtgcgaaggtcttcgtggcctaccgaccttacgaccggcgactactcctccacgtgggtcgccgacgccggccccgtaggaaccgaagggtcgttaggaggtaggtagtaggggattgggactaccgaaaaccccctaacgtaagtcggtacggactaaaccgaaacgttacgtacgaacctaaacgtaacggtaacgtttacggacgggttacgacggggtacccaaaccgtagtaacccggacgaacgggtaccgtaccggtaaccagtacacgacaaacgtacgacccagttagacgggacggtactaggacgacgaacgtacggtacaacgagttaccgaacgaacccggacgtaacggtaaccctttaattttacaaccggttcgtacgggtaacggtaaggtaccggtttacggtttaccgggtacggtttccgtttttacgggtttttaacccggg

SEQ ID NO: 349741 - DNA, 645 bp, Homo sapiens
  misc_feature: GZ8MTXP02GQAUP.45.37.D04.1.454.CMB.2.raw
  modified_base (423)..(423): a, c, t, g, unknown or other
  misc_feature (423)..(423): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtggaggaacggccgtgggcctcagtgacggtctcctgcgaaggtcttctcggctacaccttccgaccggcgactactcctccgtacgtggcgcgaccgacggccccgtggacggaaggtcgttggaggtggagtgggagtggatacaacccctaacagtgtacggacaacaaactagtcgacaatacgtagttacgagggacgaggtcaacgtnacggacgacggtacaccgtcacgtcaagccaagaccgtactacctagtgggaacgcgtaacgacgacgaacggactaggtaccagttaccggtaacgaacccggaacggtaaaccggtacccttaaagtttttaaccgtaacgttcggtacgggtaaccgtaaggggttacgtttaccggggtttaccgggtcgggttccgtttttacggtttttaacccgg

SEQ ID NO: 349742 - DNA, 554 bp, Homo sapiens
  misc_feature: GZ8MTXP02FU5LW.45.37.D04.1.454.CMB.2.raw
  modified_base (184)..(184): a, c, t, g, unknown or other
  misc_feature (184)..(184): n is a, c, g, or t
  modified_base (257)..(257): a, c, t, g, unknown or other
  misc_feature (257)..(257): n is a, c, g, or t
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
  modified_base (354)..(354): a, c, t, g, unknown or other
  misc_feature (354)..(354): n is a, c, g, or t
  modified_base (372)..(372): a, c, t, g, unknown or other
  misc_feature (372)..(372): n is a, c, g, or t
  modified_base (401)..(401): a, c, t, g, unknown or other
  misc_feature (401)..(401): n is a, c, g, or t
  modified_base (420)..(420): a, c, t, g, unknown or other
  misc_feature (420)..(420): n is a, c, g, or t
  modified_base (445)..(445): a, c, t, g, unknown or other
  misc_feature (445)..(445): n is a, c, g, or t
  modified_base (461)..(461): a, c, t, g, unknown or other
  misc_feature (461)..(461): n is a, c, g, or t
tcagacgcgatcgacacgaccggtgctcgatttagtagcatactgttgggtttgggggagagcatcacccagcaaccacatctgtcctccagagaatccccctgagagctccgttcctcaccatggactggacctggaggatcctcttcttggtgcagcagccacaagagcccactcccaggtncagctggtgcagtctggggctggaggtgaggaagccgtggggcctcagtgaaggtctcctgcgaaggtcttcnggactacacctcaccggcactanctccgacgngggtgcgaccgacggcccctaggacgaagggtcttgaggtggagtggatggatacccaacctaanagtggtgacaacacgtanagacagagtacgtagacgagacgacacanacgacgaggaccacgacanacgacacacgacactagagaggacncgtagacgacgacganacgatacgtacacgaaccgaccgacgttacttacttactagtcgtaacggtaacggtagttacggttcggttacggttccggttcgtttacgg

SEQ ID NO: 349743 - DNA, 691 bp, Homo sapiens
  misc_feature: GZ8MTXP02IYX1Q.45.37.D04.1.454.CMB.2.raw
  modified_base (689)..(689): a, c, t, g, unknown or other
  misc_feature (689)..(689): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgaggacggccaccatcaactgacagtccagccagtagttgtttagacagctaccaaacaaataagaactacttaagtcttacggtaaccagaccaaagaaaccgaggtacacgtcctacgtaagtctacgctactactttacgtgggacctacgtaccggtaaccggtacggtcccggggttacccccgtacgaaccgttacttaccggtaggtccggacgtacggggttccggggttacggtacgggaccgttaggttacctttaccgacccgtttaccgtacccaacccgtataccgaacgcctcgtacctacggccgacggtacgttagaaaggtcgtttaagggcgtttacgttaggttttacgcggtacgttacgtacgtagtaaacttaagttatttacttacgtttacttacccgtcgttaccgttccggaccgtaacggaactaacgtagtaactaacgaaccgtaacgtctacggtcgtacncg

SEQ ID NO: 349744 - DNA, 584 bp, Homo sapiens
  misc_feature: GZ8MTXP02JI5UI.45.37.D04.1.454.CMB.2.raw
  modified_base (198)..(198): a, c, t, g, unknown or other
  misc_feature (198)..(198): n is a, c, g, or t
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
  modified_base (279)..(279): a, c, t, g, unknown or other
  misc_feature (279)..(279): n is a, c, g, or t
  modified_base (310)..(310): a, c, t, g, unknown or other
  misc_feature (310)..(310): n is a, c, g, or t
  modified_base (393)..(393): a, c, t, g, unknown or other
  misc_feature (393)..(393): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgngggctgagtgagagcgtgggctnagtgagtctctgcaggcttcgngctacaccttcgaccggcgactactctccagtggtncgacgcggccccgtgacgaggcttgagtggngtgggatggactaccaaacccgtataagtcggtacgcaacgaatcgtgacacgagtagttacgagggtacacgggtacaacgngtacgacgagggaccaccggacacgtacgacgacaacgcgacctaacgagttacggacgtcgagacgacgtacggaactgacgtacgtcgtaacgacgtaccgaccggtacctagttttacgtaaccgttggtacggaacgtacggttacgttacgggttaccggtcgttaaccgtttcggttttaaccgg

SEQ ID NO: 349745 - DNA, 654 bp, Homo sapiens
  misc_feature: GZ8MTXP02FOEQN.45.37.D04.1.454.CMB.2.raw
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (257)..(257): a, c, t, g, unknown or other
  misc_feature (257)..(257): n is a, c, g, or t
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctgggctgaggtgaggagcctgggctnagtgagtctcngcagctngctacaccttcacgcactntctcagtggncgacncggccctggacaggtctgagtggagtgggatcggactaccgaacctaccgaagtggtacgacaacgaaaactgtcgactaaacgacggttaaagttcggaaaggggtcgtaaacgggtaccaacgtacgtacgaaaccggacgggaacctacgtaccctagtacgacgaaccgtaacgacggtacccttaagtaacgaggtacgacgtagaacgaccgtaagaacgttacggaaactacgttcgtaacgaaccgtaaccggaacggtttacccttaaagttttaaacgttaccggttgtaacccggttaacggaaggtttccgtttaacggggtttacccggggtgtttaccggtttacgggtttttcccttttaacggggg

SEQ ID NO: 349746 - DNA, 669 bp, Homo sapiens
  misc_feature: GZ8MTXP02HR5C0.45.37.D04.1.454.CMB.2.raw
  modified_base (286)..(286): a, c, t, g, unknown or other
  misc_feature (286)..(286): n is a, c, g, or t
  modified_base (302)..(302): a, c, t, g, unknown or other
  misc_feature (302)..(302): n is a, c, g, or t
  modified_base (477)..(477): a, c, t, g, unknown or other
  misc_feature (477)..(477): n is a, c, g, or t
  modified_base (530)..(530): a, c, t, g, unknown or other
  misc_feature (530)..(530): n is a, c, g, or t
  modified_base (550)..(550): a, c, t, g, unknown or other
  misc_feature (550)..(550): n is a, c, g, or t
  modified_base (571)..(571): a, c, t, g, unknown or other
  misc_feature (571)..(571): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggaagccgtcggggcctcgagtgaaggtctccgtgacgaaggcttcgtggctactacccttcaccggcgtaactancctaccacgtggggtnaccgacgccggcccctgggacgaacggggtcttaggagtggagtgggattaggactacctaaacccccaaacgtaagtagggtaggacaaaccgtaaaactagttaccgaacgaaacctaagggttaaacgtttcggaaacggggttaccggacggggttaacccaaccgttaanaccggggaaaccggaaaccggacgacccgtaccactacgacgcgaaaccgtanacccttaagagtacgggacnccgtaggacaccgagtaacgngacctagtccgtacgaccaaacggaccgtactttaagttacttacgtggacgcgtaaggtactttcgggttacggtcggttcgtttacgttttaccgg

SEQ ID NO: 349747 - DNA, 647 bp, Homo sapiens
  misc_feature: GZ8MTXP02FLAMU.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgagggaagccgtggggcctcgagtgaaggtctccgtgcaaggcttcgtggctacaccttcgaccggcgactatcctccgacgtgggtgcgaccgacggccccgtggaacgaagggtcttaggaggtggagtgggagtcggtaataccaaacccccgtaacgaagtgggtacggacaaacaaaactgtcgactaacgagtaagtttcgaggggacgagggtcaacctagtacggaccgagggaaccacgtaccaagtcgacgacacgacgacctacgagtaggacgctaggacgacgaaggtactagactacgtacgtacgaaccgaaccgaaccggtaccttaacttttaagtttaaccggaggttacggaacgggtaacggttacggtttacggggtttaccgggttcgggttaccggttttacgggttttacccg

SEQ ID NO: 349748 - DNA, 631 bp, Homo sapiens
  misc_feature: GZ8MTXP02G2W24.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggaagccgtggggcctcgagtgaacggtctcctgcaacggtcttcgtcggctacacccttcgaccggcgactagtcctccacgtggtgcgacgcggccccgtggaccgaaggtcttggaggtggagtgggatggactaccaaccccgtaagaagtggtggacaactaacagtacgactaacgtaagtagttacgaacggggtacgaacggggtcaaccgtagacgaacccgaggggactaccggctaactcgacgcaacgcgacctacgtagacggagtcgaaggacgacgaagcgtaacgtacgactcgtaacggaaccgtacgaccgtacgtttaaacgtttacgttaccgtagtcggaaccggtaggttacgtttacgggtttaccggtcggtttacggtttcggtttttaacccgg

SEQ ID NO: 349749 - DNA, 683 bp, Homo sapiens
  misc_feature: GZ8MTXP02GNM0D.45.37.D04.1.454.CMB.2.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
  modified_base (266)..(266): a, c, t, g, unknown or other
  misc_feature (266)..(266): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (338)..(338): a, c, t, g, unknown or other
  misc_feature (338)..(338): n is a, c, g, or t
  modified_base (464)..(464): a, c, t, g, unknown or other
  misc_feature (464)..(464): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggagatcctcttcttggtggcagcagccacaagacgcccactcccaggtgcagctggtgcagtcgtgggctggaggtgaggagccgtgggctnagtgagtctctgcagctcngctacncctcgcggcactatccncagtggtncgacncggccctaggacgaggtctagagtggagtgggtatggaacttaccgaaaccccgtaaanagttgggagacaaactaaactgacgaccacgtaaagttacgttacggacggggtactaaacggggtaccaaccgaagtacggaacccggtaagggaacccctaccggttacctagacccggaaacnccgaaaccgtacgcccgttaaaacgcgggtacgggacgtacgtaaccgggaagaccgtaagggaaacctttcggaaaactcgttaaaccggacgtaaaaccggaccgaaacggttaacccttaaagttttacgtaaccggtggttaaccggaaggtttaaacggtcgttttaaaccgggggtttcgtaacggttttccgggtttcggtttttaaccccg

SEQ ID NO: 349750 - DNA, 636 bp, Homo sapiens
  misc_feature: GZ8MTXP02FIP7X.45.37.D04.1.454.CMB.2.raw
  modified_base (294)..(294): a, c, t, g, unknown or other
  misc_feature (294)..(294): n is a, c, g, or t
  modified_base (322)..(322): a, c, t, g, unknown or other
  misc_feature (322)..(322): n is a, c, g, or t
tcagacgcgatcgacacgaccggtgctcgatttagtagcatactgttgggtttgggggagttacaacaggcaggcaggggcagcaagatggtgttgcagacccaggtcttcatttctctgttgctctggatctctggtgcctacggggacatcgtgatgacccagtctccagactccctggctgtgtctcgtggcgagaggccacatcaactgcaagtccagccagagtgttttagacagctaccaacaataagaactacttagcttcggtaccagcaacgaaaccaggtcacncctacctaagtctgctactactttacgngggacagttaccgtacccggggaacgtccccggggtaccctccggacccgtatccaggtcggcacgggtccggggtcgtcggggactagttatttccgaaccttcctaccaaccgtactaccgaacgctacgccctagacctagggccttaaggaagtagtggtacggtcttaggtttatggtctaggtactaatactaaattatttaatttatactttccgtaccgttaaccgtttccggcccgttaggtaaacccgtaaaggtcgtaaagttaacgtaacaaaacgtaacttcggtacggtacacgtaaccc

SEQ ID NO: 349751 - DNA, 747 bp, Homo sapiens
  misc_feature: GZ8MTXP02JKGUX.45.37.D04.1.454.CMB.2.raw
  modified_base (251)..(251): a, c, t, g, unknown or other
  misc_feature (251)..(251): n is a, c, g, or t
  modified_base (366)..(366): a, c, t, g, unknown or other
  misc_feature (366)..(366): n is a, c, g, or t
  modified_base (395)..(395): a, c, t, g, unknown or other
  misc_feature (395)..(395): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtggggcctcgagtgaaggtctctgcaggcttcnggctacaccttcaccggcactatcctccacgtgggtgccgacgaccggtcccctgggaaccgaaggggtcttaggagtgggagtggggtactggaactccgaaaccccccgtaanaaggttcggaggacctaaacgaaacgttntacggacccaacgtaaaagttaaacggtttcgaaacgggggtcccgtaaacgggggttacccaaacccgtaagtacccgggaaacccgaacgggggttaaaccccaccgggtttaccgtacctacggaaacgcccaaaccgttaccggaaacccttacggaagttacggggaactgtacggaacgtacgaacggcccttaggtaaacccgagtaccggtaaccggaaccggtaacccggtaaaccgtaccgtttaactttaacgttaccgtacgggtacgtaacgggtaacggtttacgggtttaccgggtttacccgggttacggtttaccggtttttacggttttacccg

SEQ ID NO: 349752 - DNA, 657 bp, Homo sapiens
  misc_feature: GZ8MTXP02I86VV.45.37.D04.1.454.CMB.2.raw
  modified_base (322)..(322): a, c, t, g, unknown or other
  misc_feature (322)..(322): n is a, c, g, or t
  modified_base (484)..(484): a, c, t, g, unknown or other
  misc_feature (484)..(484): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggagggccaccatcaactgacaagtccagccagagtgtttagacagctacaacaataagaactatagcttaggtaccagacaacgaaaccaggtacacgcctactaagctgctctatttacgnggctacgtaccgtaccgggaacgtcccgggtacccctacgaccgtagttcgagtcggacgacggggtccgggtcgtacggggactagtacgtttacaaccgtcctacctaacctacgtcaacgtccgacgcccgtacggacgacgggctaagggtaaaacgngttaggtcggtacgttagttttacgcgtacgttacgttacaggttaaacttaattaatttaacttactttaaccgttcccgttaccgttaaccggtttcccggacccgttaacgggtaaacctaaaggtcgtaaactaacgtaacgtaaaaccgtcgtaagtcggacctacgg

SEQ ID NO: 349753 - DNA, 628 bp, Homo sapiens
  misc_feature: GZ8MTXP02G9AI0.45.37.D04.1.454.CMB.2.raw
  modified_base (248)..(248): a, c, t, g, unknown or other
  misc_feature (248)..(248): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtggggctcagtgaggtctcctgcaggcttntggctacaccttcaccggcgactatcctccacgtggtgcgacacggcccctggacgaagggcttggagtggagtgggatggataccaaacccctaacaagtcgggtacggacaacaaactagtcgacaacgaagtaagtttacgaaggggtcacggggtacaaccgagtacgaccgaacgggacaccgtaccgactacgaacgacaaccgacgaccctaaccgtagtacgggagaccgtaggaacgacaggacctaggactaacgtaccgtacggaccgaaaccgaccggtaccttaacgtttacgttaaccgttggtacgtccggtaaggtacgtttacggtttaccggtcgggtttccgtttacgggtttttacccgg

SEQ ID NO: 349754 - DNA, 655 bp, Homo sapiens
  misc_feature: GZ8MTXP02JIZCD.45.37.D04.1.454.CMB.2.raw
  modified_base (252)..(252): a, c, t, g, unknown or other
  misc_feature (252)..(252): n is a, c, g, or t
  modified_base (533)..(533): a, c, t, g, unknown or other
  misc_feature (533)..(533): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtggaggaagccgtggggcctcgagtgaggtctctgcgagcttcnggctacaccttcaccggcgactatctccgacgtgggtgcgacgaccggccccgtaggacgaacggggtcttaggaggtagggagtggggtatgggaactaccaaacccccgtaaagtacgtacgggtacggacaaactaaacgtagtcgacaagtagtaacgtttacgaggggcacggggtacaccgtagacggaaccgagggaccaccgtaccactacgacgactaccgacgaacctacgagtaggacgtacgtacgacggacgacgtacgtacgtaacncgtacgtacggaccgacgtaacccgtacgttaacgttttaacgtacgttaggtccggtaacggtacggttacggtttacggggtttccgggttacggtttccggttttacggtttttaccgg

SEQ ID NO: 349755 - DNA, 567 bp, Homo sapiens
  misc_feature: GZ8MTXP02JXVT5.45.37.D04.1.454.CMB.2.raw
  modified_base (225)..(225): a, c, t, g, unknown or other
  misc_feature (225)..(225): n is a, c, g, or t
  modified_base (323)..(323): a, c, t, g, unknown or other
  misc_feature (323)..(323): n is a, c, g, or t
  modified_base (331)..(331): a, c, t, g, unknown or other
  misc_feature (331)..(331): n is a, c, g, or t
  modified_base (429)..(429): a, c, t, g, unknown or other
  misc_feature (429)..(429): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctnagtgaaggtctcctgcaaggcttctggctacgaccttcaccggcgactatctccactgggtcgcgactacggcccctggacaagggcttgagtggagngggatggntcaaccccgtaacaagtggtcggcacaaactatgacacgtagaacgtttcgaaggggcaggggtacaccgtagacgaccgagggacacggtacccaancgacgacaacgacgacctacgagtaggagacgagacgacgacgtacagactacgtacgtacgacgacaccgtacttaacttacgtacgtagtacgaacgtaggtacgttcggttacggtcgttcggtttcggtttacg

SEQ ID NO: 349756 - DNA, 822 bp, Homo sapiens
  misc_feature: GZ8MTXP02IXATE.45.37.D04.1.454.CMB.2.raw
  modified_base (259)..(259): a, c, t, g, unknown or other
  misc_feature (259)..(259): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactccccaggtgcagcgtggtgcagtcgtgggctgaggtgaggaacggcccggggctcgagtagaggtctcctgacaaggtcttcgnggctaccaccttccgaccggctactactcctccacgtgggtcgccgacgaccgggtccccgtaggaaccgtaaggggtcctttaggagggtagggtacggttaggggtaacgttacggggtaaccttaaaccccgtaaaacccccgttaaaacgtaaacggtttacgggggttaaccgggaaacccctaaaaaccgttaaaaaacccgttacgttaccgggtaaaccgtaaaaccggttaaacggggttaaaacgggtttttaacccggggaaccggggggttaaaccggtaaccgggggtttaaacccaacccggtaacgttaccgggaaacccggtaaacgggggtaacccgtaaacccgttaccccgaagtacccgaacgacccgtaaccggaactacccgtaacgaacggttcggaacgtcgtacggacgacgaaggtcgtaacgactaacgtcgtacgaaaccggaccgtaaccggtacctttaacttacgtacgtacggtcggacgtaagtaacggtttcggttaccggtggttccgtttacggtttcgttttacgg

SEQ ID NO: 349757 - DNA, 764 bp, Homo sapiens
  misc_feature: GZ8MTXP02IKJ0V.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagacgcccactcccaggtgcagctggtgcagtcgtgggctgaggtgaggacgccgtgggctcgagtagaagtctcgtgacgaggtcttcgcggtactaccacctttacgaacccgggtcgaacctactcccgtacccgacgttcggggttcgaccgaacgaaccgggcccccgttaggggaaccggtaaaggggtcttagggtaagggtcgggtaagtggggtaagttcgggaaacttacccgaaaacccccgttaaacgtaacggttggggttacggaactaaaccgtaaaacgtggttacgaacctaaccggtaaagtaacggtttcgaaacggggtacggagggtaccaacgagtacgaccggaacgggactaccgtacacgtaccgaagaccaaacgaccgtaaccgttaacgacgttacgggaacgtaaccgtggaaacgacgtaacggtaacgttacgaaacgtacgtacgtaacggaacccgtaaacgaccggttaactaacgttttacgttaaccggttgacggttaacggtacggttacgtttacggggtttaaccggtcggttttaccgttacggttttttaacccggg

SEQ ID NO: 349758 - DNA, 700 bp, Homo sapiens
  misc_feature: GZ8MTXP02IKFG7.45.37.D04.1.454.CMB.2.raw
  modified_base (185)..(185): a, c, t, g, unknown or other
  misc_feature (185)..(185): n is a, c, g, or t
  modified_base (255)..(255): a, c, t, g, unknown or other
  misc_feature (255)..(255): n is a, c, g, or t
  modified_base (299)..(299): a, c, t, g, unknown or other
  misc_feature (299)..(299): n is a, c, g, or t
  modified_base (324)..(324): a, c, t, g, unknown or other
  misc_feature (324)..(324): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgaccagtctccagactccctggctgtntctcgtgggcgagagggccaccatacaactgcaacgtccagaccagtagttgttttagacagcctacaanaataagaactactagtctaggtaccagcaagaaaccaggtcacncctaccaagctgctactatttacgnggcataccgtaaccggaacggtccggggtaccccctacggaccgtagttcgagtcggacacggggtaccggtcgtacgggactagttactttcctaacctctaccaaccctactacacgactacgccgtagcgacggacgtacgaaaggtatggtacggtacgttagtttagtagtccgttagtaccgtagtaccttaaatttaaactttagttaaaacttttcccttacccgttttaccccgttaaaacccgttttccccggggtaaccccggttaccggggtaaaacccggttaaaagggttacgggttaacgttaaaccttaaaccgtaaaaaaaccggttcgtaacggttaacggggtttacctaaacccgg

SEQ ID NO: 349759 - DNA, 710 bp, Homo sapiens
  misc_feature: GZ8MTXP02HEZY7.45.37.D04.1.454.CMB.2.raw
  modified_base (279)..(279): a, c, t, g, unknown or other
  misc_feature (279)..(279): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggagccgtgggcctgagtgaggtctcgtgcgaggtcttgcggctacaccttcgaccggctactactccnccacgtggtcgcgacgacggccccgtaggacgaaggtcttggacggtggagtgggagtcggactaccaaacccctaagaagtggtacgacaaacaaactgtacgacaacgtaagtaagttcggagggacgtaggtaccaacgtagacggaacgacgggacctaaccgacctaagccgacgaccaacgtaaccgtaacccgtaagtaacgtacgggtaccggtagacggaaacgaccgaaacggtaccgttaacggaacctaacgttacccgaacggtaaaacccgacccggtaaaccggttaacccttttaaagttttaacccgtaaaccggttggttaaccggtaacgggttaaacgggtttaacggttttacccggggtttaaccgggttccggtttccggttttttaccggttttttaaccccggggg

SEQ ID NO: 349760 - DNA, 592 bp, Homo sapiens
  misc_feature: GZ8MTXP02F9FZN.45.37.D04.1.454.CMB.2.raw
  modified_base (284)..(284): a, c, t, g, unknown or other
  misc_feature (284)..(284): n is a, c, g, or t
  modified_base (558)..(558): a, c, t, g, unknown or other
  misc_feature (558)..(558): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggctcagtgaaggtctcctgcaaggcttctggctacaccttcaccggcgactatctccatgggtncgtacgacggcccctggacgaagggtcttaggaggtggattggggatgggactaccgaaccccccttaagaagtgggtcggacaaccgaaacttagtcgaccaacgtaagtaacgtttacgaggggccgtaaggggtccaacccgtagtacggaccgaacggggaccaccggtaccagtcacgcacacgcctacagtggaacgctacgagcaaggtaccagaccatcgtacggacgacgacgtcctacgtttaatctcggtagcggtaacggtntttacgggttaccggtggtcgtttcggttttccg

SEQ ID NO: 349761 - DNA, 703 bp, Homo sapiens
  misc_feature: GZ8MTXP02HJR4B.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctggaggtgaggacgccgtggggcctcgaggtgaacggtctccgtgcgaaggtcttcgtggctacctacccttcgaccggcgaactactcctccacggtggtcggccgacgaccgggcccccgtaggaccgaaggggtcttaggacggttaggggagttggggaactgggtaacctacccgtaaaaccccccgtaaaccgtaaggtacggggtacgggacctaaaaccgtaaaacgtagtacgaccgtaaacgtaagggttaaacgtttaccggaagggggtacgacggggtaccaaccgtagtacggaaccgacgggacctacgtaccatcgacgcactacgacctagacgtggacgtcgtaggacgacgagtacgtacgactacgtacgtacggacccgtaccgacccgggttaccttaagtttaacgttacgttcggtaggaaccgggttagttacggttaccggggttacgtccggtttacgtttccggttttacgg

SEQ ID NO: 349762 - DNA, 564 bp, Homo sapiens
  misc_feature: GZ8MTXP02GZHO2.45.37.D04.1.454.CMB.2.raw
  modified_base (353)..(353): a, c, t, g, unknown or other
  misc_feature (353)..(353): n is a, c, g, or t
tcagacgcgatcgacacgaccggtgctcgatttagtagcatactgttgggtttggggagcatcacccagcaaccacatctgtcctctagagaatccccctgagagctccgttcctcaccatggactggacctggaggatcctcttcttggtggcagcagccacaagagcccactcccaggtgcagctggcgcagtctggggctgaggtgaggagccgtggggcctcagtgaaggtctcctgcaggctctggctacaccttcaccggcgactactcctccactgggtgcgacacggcccctggacaaggcttgagtggatgggatggatcaacccctacatggcgcaacaactngacacagtagttcgagggcaggtcacgatcgaccgagggaccacggtaccagtaccgagaccaacgtacgaccttaacgagttcgggacgtactaggacgacgacgacgtgacgtatcgtacggacgtacgaccggtccttaatttacgttacgtgtaggaacgagttacgttacggtttaccggtggttaccgtttacgggtttttccgg

SEQ ID NO: 349763 - DNA, 690 bp, Homo sapiens
  misc_feature: GZ8MTXP02HDZY3.45.37.D04.1.454.CMB.2.raw
  modified_base (280)..(280): a, c, t, g, unknown or other
  misc_feature (280)..(280): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagccccactcccaggtgcagcgtggtgcgaggtcgtgggggctggaggtggaaggagccgtggggcctgagtgagtctctgcgaggctcgtggcacacctcgaccgcgactntcctccagtggcgcgacgcggccccaggacgagggcttaggaggtggagtggtatcggaactaccccgaaacccgtaagacggttggacgaaccaactaacgtagtacgaaccgaacgtaacgggttaaacgttacgggaacgggtacggtaaccgggtacctaaccgacggtaaccggaaacccggacgggaacccgtaccgttacccaagacgacgaccgaccgtaacgtacccgtaagtaagggtacgtacggtacccgaggacggaacgacggacgttaaaccggctacgtaccgtaaccggaccgtaaccgtaaccgtaccgttaattttacgaccggttagtcggtaaccggtaggttaaccggttcggtttaccgggtacgggtttcctttttaacccggggg

SEQ ID NO: 349764 - DNA, 689 bp, Homo sapiens
  misc_feature: GZ8MTXP02FPTDU.45.37.D04.1.454.CMB.2.raw
  modified_base (183)..(183): a, c, t, g, unknown or other
  misc_feature (183)..(183): n is a, c, g, or t
  modified_base (295)..(295): a, c, t, g, unknown or other
  misc_feature (295)..(295): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatctcttcttggtggcagcagccacaagagcccactcccaggtncagctggtgcagtctggggctgaggtgaaggagccgtggggcctcgagtgaggtctcctgcaagcttctggctacaccttcgaccggcgactactctccacgtggtgcgacncggcccgtcggacaacgggcttcggagtcgggtatcggggaagtgggtactacccgtaaacccgtaaacaagttcgggttagggaccaaaacgtaaccgtagtacgaccgaaacgtaagtaaagtttaccgagggggtaccgaggggttaccaaccgaatacggaaccgtaaggacccgtaggtacccataccgagaccgaacgtaaaccgtccgttaacgacgttacggggaactaccggtaggaacgacggttaaacggaccttaacgggacctaacggtttaccaccgggaaccgttaaccgacccggtaactttaaccgttttaaagtccgttacggtaagtaccggtaaaggtacttacgggtttacgggcgttacggtttttcccggg

SEQ ID NO: 349765 - DNA, 710 bp, Homo sapiens
  misc_feature: GZ8MTXP02FLRCZ.45.37.D04.1.454.CMB.2.raw
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactcccaggtgcagctggtgcagtctgggctgaggtgaggaagccgtggggcctgagtgaaggtctcctgcaggctcngcacnctcncggcgactanctccactggtcgccgacacggccccctggaacaacgggcttaggacgtggagtcggggtaatggacttaccaaacccccccgtaacgaaacgtcgggtacggaccaaccaaaacgtactacgacctaacgaacgttaaacgtttttcgaaaggggtccgtaaacggggttacctaacccgaagttacggacccgaaacgggggttaccaaccggttacccaaacttccgaacggaccctaaaccgtacggaccctaaccgttagtacgggaaacgttcgtacggaacgactaaacggacccttaagggaaacccgtagttaacctacggaaaacccggaaccgaacccgggtacccttaaactttaacgttaaccgtgttacggaaccgtaagggtacgttacggttacccggtggttcccgttaacggtttttaccccgg

SEQ ID NO: 349766 - DNA, 545 bp, Homo sapiens
  misc_feature: GZ8MTXP02I4ONM.45.37.D04.1.454.CMB.2.raw
  modified_base (238)..(238): a, c, t, g, unknown or other
  misc_feature (238)..(238): n is a, c, g, or t
  modified_base (349)..(349): a, c, t, g, unknown or other
  misc_feature (349)..(349): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtctggggctgaggtgaggagccgtggggcctcagtgaggtctcngcaggctctggctacaccttcaccggcgactatctccactgggtgcgacacggccccctggacagggcttgagtggatggatggatcaacccctacatggtgcacgaactntgacacagtagtttcgagggcgacgggtcaccgagtacgaacgagggacaccggtacatcagcaacacgcctacagtggacgctgagacaggaactgaacactcgtacgacgaaccgcggtacctattttactaacgttgttagaacggtaggtacgtttacggtttaccgggtggtccgtttcggtttttaccgg

SEQ ID NO: 349767 - DNA, 696 bp, Homo sapiens
  misc_feature: GZ8MTXP02FQXD5.45.37.D04.1.454.CMB.2.raw
  modified_base (401)..(401): a, c, t, g, unknown or other
  misc_feature (401)..(401): n is a, c, g, or t
  modified_base (508)..(508): a, c, t, g, unknown or other
  misc_feature (508)..(508): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctgaggtgaggaacgccgtggggcctcgagtaggaacggtctccgtgacgaaggtcttcgtggactaccaccttccgaccgggcacttactcctccagttgggtcgaccggtaccgaccggtcccccgtagggaacgtaaggggtctttagggaggttgggaggtgggaacgtggaactaccccaaaacccgtaanaggtcggtacggacaaacgactgtacggacaacgtagttaacgtttcggacgggacgtacgggtaccacgtaacgccggaaacgacggaaccgtaccgtacccgtanaccgacgacgaacctacggtaccctaagaggtaggtaacgtccgtagacggacaaacgacgtacggaactacgttctaacggaacccgtaaccgtaccgggtacctttaagtttaacgttaccgtagggtcggtaacggtaacggttcggtttaccggtttaccgggtgggtttcgttttttaccggg

SEQ ID NO: 349768 - DNA, 636 bp, Homo sapiens
  misc_feature: GZ8MTXP02ID6IA.45.37.D04.1.454.CMB.2.raw
  modified_base (184)..(184): a, c, t, g, unknown or other
  misc_feature (184)..(184): n is a, c, g, or t
  modified_base (199)..(199): a, c, t, g, unknown or other
  misc_feature (199)..(199): n is a, c, g, or t
  modified_base (294)..(294): a, c, t, g, unknown or other
  misc_feature (294)..(294): n is a, c, g, or t
  modified_base (475)..(475): a, c, t, g, unknown or other
  misc_feature (475)..(475): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtncagctggtgcagtcngggctgaggtgaggaagccgtgggcctcgagtgaacggtctcgtgcgaaggcttctggctacaccttcaccggcgactactctccacgtgggtcncgaccgacggcccctaggacgaaggtcttggagtggagtgggatggactaccccaaaaccctaacagtcgggtacgacaaacgtaacgtgtacgaccgtaaacgagttaacggtttcggaagggtaccgtagggaccaaaccgagtacggaacccgagggacctaacggtcaactaccganccaaacgtacgaccctaagacgtagacgtcgagacgacgaacgactacgactacgtacgaacggaccgtaacgtacggacctttaatttaacgttaccgtaggtaacgtacgggtaagttacgtttacggggtttaccggtacggttacgtttttaccggg

SEQ ID NO: 349769 - DNA, 695 bp, Homo sapiens
  misc_feature: GZ8MTXP02GLFOY.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccacctcccaggtgcagcgtggtgcagtcgtggggctggaggtgaggacgccgtgggctgagtgaggtctcgtgacgtaaggtcttcgtcggctacctacccttcgaaccgggtcgaacctactcctacccgacgtggggtacgaccggaccgtacgggcccccgtaggaaccgaagggtcttaggagtggagtgggagtgactaccaaccctaacgagtcggagacaacaatgcacagaagtagttacggaggacgacgtacactgaacgacgacgacgactacaacgcgagacctaaaccgacgtacccgttaaacgtaggtaacggacgtaccgaaccgggaagtaaccggtacggaaacttacggaaccttaaaccgtacggtaacggaacccggtaaaccggtaccgttaaacctttaaacgtttaccgttacgggtacggtacggtaaccgggtaggtttaaccgggtttaccggggtttaccggttcgggttttaccggttttaccgggttttaccgg

SEQ ID NO: 349770 - DNA, 577 bp, Homo sapiens
  misc_feature: GZ8MTXP02F2UTI.45.37.D04.1.454.CMB.2.raw
  modified_base (227)..(227): a, c, t, g, unknown or other
  misc_feature (227)..(227): n is a, c, g, or t
  modified_base (300)..(300): a, c, t, g, unknown or other
  misc_feature (300)..(300): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagctggggcctnagtgaggtctcctgcaaggcttctggctacaccttcaccggcgactatctccactgggtgcgacacggccccnggacgaagggctttgagtgggatggggatggactcccgaaacctacgaatgggtcggacaacaactatagcgtaacagtaacgtttcagggacgagggtccacagtcgaaccgaggaccacgtaccagtacagaccaacacgtcccgtaacaacgtgggaatccgtagacgacgaaagccgttagaactacgtctacgaccgaccgacggtactactttaacgttacgttgtcggcggtaagtcggtttacggtttacggtcggtacgtttttcggg

SEQ ID NO: 349771 - DNA, 684 bp, Homo sapiens
  misc_feature: GZ8MTXP02HOAI6.45.37.D04.1.454.CMB.2.raw
  modified_base (254)..(254): a, c, t, g, unknown or other
  misc_feature (254)..(254): n is a, c, g, or t
  modified_base (308)..(308): a, c, t, g, unknown or other
  misc_feature (308)..(308): n is a, c, g, or t
  modified_base (486)..(486): a, c, t, g, unknown or other
  misc_feature (486)..(486): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggagccgtggggcctcgagtgaaggtctcgtgcaaggtcttcnggctacaccttcaccggcgtactatcctccacgtgggtgcgacgacggtccccnggacgaaggtctggagtggagtcgggagtggactaccaacccccgtaacagtcgggtggacaacgtaactatcgacacgtagtaacgtttcgagggaccgtaacggggtcaaccgtacgtacgaccgtaacgggactacggccactacgacaccgacacggtaccacgtagtacgggngtaccgtagacgtacacggactagaaccgtacgttacgtacggaacccgtaccggtaaacccgggtaaccttttaagttttaaaccggtttacgttacggggtttaccggaaccggggtttagggtttaacggtttaccggggttttaaaccggggtttccggggtttaaccggttttcgggttttttaaccccgggg

SEQ ID NO: 349772 - DNA, 564 bp, Homo sapiens
  misc_feature: GZ8MTXP02ILD9G.45.37.D04.1.454.CMB.2.raw
  modified_base (227)..(227): a, c, t, g, unknown or other
  misc_feature (227)..(227): n is a, c, g, or t
  modified_base (276)..(276): a, c, t, g, unknown or other
  misc_feature (276)..(276): n is a, c, g, or t
  modified_base (302)..(302): a, c, t, g, unknown or other
  misc_feature (302)..(302): n is a, c, g, or t
  modified_base (459)..(459): a, c, t, g, unknown or other
  misc_feature (459)..(459): n is a, c, g, or t
  modified_base (462)..(462): a, c, t, g, unknown or other
  misc_feature (462)..(462): n is a, c, g, or t
  modified_base (484)..(484): a, c, t, g, unknown or other
  misc_feature (484)..(484): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtgggcctnagtgaaggtctcctgcaaggcttctggctacaccttcaccggcgactanctccacgtggtgcgacgacggccccnggacaaggcttgagtggatgggatggatacaacccctaagaatgggtcggacaacaaactagtgacaacgtaagtaagtttcgaagggtaccgaggggtaccaacccagtacgaaccaacggggactacggtaccatacacgacacgattaccctanagngagcagagcagactgacatacncgacgacgacggacctaattaccttacgtagtcgtaacgtaggtagttacggttaccggtacggtcgttacgttttccgg

SEQ ID NO: 349773 - DNA, 602 bp, Homo sapiens
  misc_feature: GZ8MTXP02JT2XG.45.37.D04.1.454.CMB.2.raw
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (296)..(296): a, c, t, g, unknown or other
  misc_feature (296)..(296): n is a, c, g, or t
  modified_base (494)..(494): a, c, t, g, unknown or other
  misc_feature (494)..(494): n is a, c, g, or t
  modified_base (526)..(526): a, c, t, g, unknown or other
  misc_feature (526)..(526): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccgaggtgcagctggtgcagtcgtgggctggaggtgaggacgccgtggggcctcgagtggaggtctctgacgaggtcttcgnggctacnccttcgaccggcactactctccacgtggtcncgacacggcccctagaacgagggtcttagaggtggagtgggatggactaccaaaccctaacgagtggtacgacaaacaaacgtgtacgacaacgagtacgttacgagggcgtaggaccacgagtaccgaccgagggacctaccggactacgacacgacctaacgaccgacaactaggtaccggagtaccgagaccggnaacggactagacctatacgacgaacgaaaccnccggttaaccttagtttacgtacctggtagaacgtagtagtttacggtcgggttcttaccggtttcgttttaccgg

SEQ ID NO: 349774 - DNA, 739 bp, Homo sapiens
  misc_feature: GZ8MTXP02JP3N8.45.37.D04.1.454.CMB.2.raw
  modified_base (237)..(237): a, c, t, g, unknown or other
  misc_feature (237)..(237): n is a, c, g, or t
  modified_base (382)..(382): a, c, t, g, unknown or other
  misc_feature (382)..(382): n is a, c, g, or t
  modified_base (393)..(393): a, c, t, g, unknown or other
  misc_feature (393)..(393): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtctggggctgaggtgaggagctgggcctcagtgagtctctgnaagtctctggctactaccttcgccggctactatcctacctacgtgggtcgcggacgaccggtccccgtgggaacaaggggtctttagggacgtgggagtggggtactgggtactaccaaaacccccgtacgaaagtgggtacganaacccaaaatntacggcaaactagtaacgtttacggacgggttcgaacgggtccaaacgtacgtacggaaccgagggtaaaccacggttacccaaacgtcaaccggtacaaacccgtaccggttaaccgaaccggtaaaggttccggggaataccggttacggaaccgggttacgtaaacccgggaagttaccggaaacgtttaaccgtaccggtaaaacggaccgtaaaccggaaccggttaccgtttaaacggttttacgtaccgttaacggtacgggttaacggtaacgggtttaacggtttaccgggggttttaccggttacgggttttaaccggttttaccggttttaccgg

SEQ ID NO: 349775 - DNA, 620 bp, Homo sapiens
  misc_feature: GZ8MTXP02JPUC9.45.37.D04.1.454.CMB.2.raw
  modified_base (263)..(263): a, c, t, g, unknown or other
  misc_feature (263)..(263): n is a, c, g, or t
  modified_base (310)..(310): a, c, t, g, unknown or other
  misc_feature (310)..(310): n is a, c, g, or t
  modified_base (379)..(379): a, c, t, g, unknown or other
  misc_feature (379)..(379): n is a, c, g, or t
  modified_base (428)..(428): a, c, t, g, unknown or other
  misc_feature (428)..(428): n is a, c, g, or t
  modified_base (441)..(441): a, c, t, g, unknown or other
  misc_feature (441)..(441): n is a, c, g, or t
  modified_base (470)..(470): a, c, t, g, unknown or other
  misc_feature (470)..(470): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcaggcagccacaacgagcccactcccaggtgcagctggtgcagtcgtggggctggaggtgaggagcctggggcctcgagtgaaggtctccgtgcaggtcttgtggctacnccttcaccggcactatcctccacgtgggtcgccgacacggtccccgnggtaccgaagggtcttgaggtggagtggagtggactaccaaccccctaagtagtgtacgacaacaaatntcgacatagtagttcgaggtacagggtacacgtatcgaacgacggtacnccgtacagtcganacgactaccgcaaacgtgtcgacggtacngaaagccgttaaggacctaggaacctagttaccctaagggaacccgtacgtaccccggtcctttaagtttaaccttaaccggtgtacccggaacgggtaagttacgtttacggtttaccggggtacgtttccggtttacggtttttccgg

SEQ ID NO: 349776 - DNA, 732 bp, Homo sapiens
  misc_feature: GZ8MTXP02GSBDU.45.37.D04.1.454.CMB.2.raw
  modified_base (298)..(298): a, c, t, g, unknown or other
  misc_feature (298)..(298): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtggaggaagccgtgggccgtcagtgaaggtctccgtgcaaggcttctggctacaccttcaccggcgactatcctccacgtgggtcgcgacncggacccctggacaagggtcgttggacggtgggtagtagggagtgggtaactacccgaaacctaaaccgaagtcgggtaggaccaaactaaaaccgttatcgacaaaccgtaaggttaaacgtttacgaacggggaccgtacggggttacccaaccgtaagtaccgaaacccggacggggaaaccctaccgtaccccgtaacgtaccgaacggtaccaacgaacccgtacccctaaacggaacgttacgggaacgtcgtacgacggaccgaacggacgttacgaacgtactacggtaccgaaaccggaccgtaaaccggtaccgtttaagtttaacgtttaccgtcggttaccgtaagggtaacggttacgtttaaccggggttttccgggtacggtttccggtttccggggtttttaacccgtttttccgggg

SEQ ID NO: 349777 - DNA, 621 bp, Homo sapiens
  misc_feature: GZ8MTXP02GS150.45.37.D04.1.454.CMB.2.raw
  modified_base (338)..(338): a, c, t, g, unknown or other
  misc_feature (338)..(338): n is a, c, g, or t
  modified_base (400)..(400): a, c, t, g, unknown or other
  misc_feature (400)..(400): n is a, c, g, or t
  modified_base (440)..(440): a, c, t, g, unknown or other
  misc_feature (440)..(440): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgacccagtcctccagacctcccgtggctgtgtctcgtgggcgaggacggccaccatcaactgacaagtccagccagtagttgtttagacagtctaccaaacaaataagaacttacttagcttacggaaccagacaaagaaaccaggtcacgcctaccgaagcctgcttcagtttacgngggtacacttaccgggtacccggaacgttcccggggtcccctagacctagtccaggtccggncgggcggtgtcggggacagtactttcaacgtctccactancgtacgcacgccctggcacggactgaaaagtcgtggtacgtacgttagtttatcggacttgtacgacgtaactaattaatttaattacttacttaccgttaccgttaccgttccgtaccggtacggtaaccgtaacgtagtaacgtaactaacgtaaacgtaacgtacggtacgacgtacg

SEQ ID NO: 349778 - DNA, 724 bp, Homo sapiens
  misc_feature: GZ8MTXP02JW1BA.45.37.D04.1.454.CMB.2.raw
  modified_base (306)..(306): a, c, t, g, unknown or other
  misc_feature (306)..(306): n is a, c, g, or t
  modified_base (315)..(315): a, c, t, g, unknown or other
  misc_feature (315)..(315): n is a, c, g, or t
  modified_base (335)..(335): a, c, t, g, unknown or other
  misc_feature (335)..(335): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtggcgaggacgggccaccatccaaacgtgacaagtccagccaggagttagtttagacagacctccaaacaataagaactactagcttggtaccagactaacgaacctgacacncctactaancgtagctacgtactttacgnggactacgtaccggtaacccggacgttccccggggtcccctacgaccgtacgttacgtaggtcggacgtacggggttccggggtacgtacggggtacacggttacgttttacccccgaccttaccgaacccgtaaacctacgtaacgacccggtaaccgacccggttacccgtaaggtaccggtaacggacgtaacggttaaaggtggttaacgggtacgttaacgtttagtttacgtcgtaccggtacgtacgtaattaaacgttaatttaactttacgtttaaccgttcccgttacccgtaccggtttaccgttccgggaaccgttaacggtaaactaaggtactaacgtaacgtaaaccggtaagtccgtcgtacggtactaaccg

SEQ ID NO: 349779 - DNA, 611 bp, Homo sapiens
  misc_feature: GZ8MTXP02FM465.45.37.D04.1.454.CMB.2.raw
  modified_base (223)..(223): a, c, t, g, unknown or other
  misc_feature (223)..(223): n is a, c, g, or t
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagcgtgggcnagtgagtctcngcagctngctacnctcacgcatanctcacgnggtncgnacgccctggacaggctaggagtggagtgggatgataccaacctaacagtggtagacaaactaaactgtcacaacgtagttacgttcgagggtcacgttacacgagtcgaacgacggactacgtaccagtacgaacgacacgacggtaccaacgtaggtacggacgtacgtagacgacgaagtacgtacgtaactacgtacgaccggaacgtaacccggtaacggtaacctttaacgtttaacgttaacggtttcggcggtaaccgggttaagggttacgtttaccggggttttaccgggtcggtttaccggtttacggggtttttccctttaaacgggg

SEQ ID NO: 349780 - DNA, 727 bp, Homo sapiens
  misc_feature: GZ8MTXP02G0UIO.45.37.D04.1.454.CMB.2.raw
  modified_base (189)..(189): a, c, t, g, unknown or other
  misc_feature (189)..(189): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggngcagtcgtggggctgaggtgaggagccgtgggcctgagtgaaggtctcgtgacgaggtcttcgtggactaccacccttcgaccggacgactactcctccgtacgtgggtcgaccgaccgaccggccccgtaggaacgtaacggggtcgttggacggtggtagtagggaagtacggaactacctaaaccccccgttaaacgaagttacgggtacggtacaaacctaaaccgtagtacgacaacgtaaagttaacgttacggacggggtacgaacggggtacccaaacgtaagtccggaaaacccgaggggaaccctaacccgggtacctaaagtcccgaacgtacgaaaccgttacgaccccgttaagaggttacgggacgtccgaggaacgccgtaagacccgtgaacttacgtcctaaacggacccgaccgtaccggaaaccttttaggtttaactaccggtaggttaccgaacggttaaacgttaaggttttccggttacccgggtagggtttccgtttttaacggtttttcccgg

SEQ ID NO: 349781 - DNA, 643 bp, Homo sapiens
  misc_feature: GZ8MTXP02JFEP4.45.37.D04.1.454.CMB.2.raw
  modified_base (253)..(253): a, c, t, g, unknown or other
  misc_feature (253)..(253): n is a, c, g, or t
  modified_base (339)..(339): a, c, t, g, unknown or other
  misc_feature (339)..(339): n is a, c, g, or t
  modified_base (489)..(489): a, c, t, g, unknown or other
  misc_feature (489)..(489): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccaacaagacgcccactcccgaggtgcagctggtgcagtcgtgggctggaggtgaggacgccgtggggcctgagtgacgtctctgcaggtctcgngctacaccttcgaccgcgtactatcctaccacggtgggtcgaccgaccgtaccggccccgtaggacgaagggtcttggaggtaggngtgggatggactaccgaaacccctacgaagtcggtacgaccaactaatgtacgacaacgtagttaacgttcgaacgggcgacggtaccacgagtaccggacgaggtaccaccgtacgacacgacgcaacacgacctacgagacgggtacncgcgaacgtacgagaccgtaagtaccgtagttcgaacgtacccggtaaacaccggtaaactttacgtttaaacgttcgtagggtacgtaaccggtaagggttacgttttacgggttacgggtttccggtttcggttttaaccgggtttttccgg

SEQ ID NO: 349782 - DNA, 727 bp, Homo sapiens
  misc_feature: GZ8MTXP02HUL10.45.37.D04.1.454.CMB.2.raw
  modified_base (246)..(246): a, c, t, g, unknown or other
  misc_feature (246)..(246): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccaacaagagcccactcccaggtgcagctggtgcagtcgtggggctgaggtgaggaagcgtgggcctcgagtgagtctctgcgagcttntcggactacaccttcgaccggtcgactactcctccacgtggggtcgccgaccgaccggggtccccgtaggaaccggtaagggtcgttaggacggggtgggtaggttaggggaagtacgggtaactacccgtaaaacccgtaaacgtaaacggttacggggtacgacctaaaccgtaaaactagtacggaccgaaacgtaaaggttaacggtttacggtaacggggacggtaaccggggtacctaaacccgtacgtacccggaaacggtaaccgggaaccgtaacccggttacccaattacgacgaccaacgtacgacccgtaacgaagttcggaacgtcgtaacgagacgacgtacgacgaactacgtacgtaacggacgtaccggaccgttaaccgttatttacgtttaacgcgttacggacggtaaggttacgttcggggtttacggtacgggttcgtttcgggttttactaccggggg

SEQ ID NO: 349783 - DNA, 696 bp, Homo sapiens
  misc_feature: GZ8MTXP02JZ5UA.45.37.D04.1.454.CMB.2.raw
  modified_base (491)..(491): a, c, t, g, unknown or other
  misc_feature (491)..(491): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctccgtgcgaaggtcttcgtcggtctaccacccgttacgaccggcgactacgtcctccgtacggtggggtcgaccgaccgaccggtcccccgtaggaaccgtaagggtcttaggaagtagaggtggggagtcggaactacctaaaccccctaaacaggttcggtaggacaaacaaactgtagacacgaagtaaggtttacggacgggacgacggggtaccaaccgagtacgaccggaggaccaccgtctaancgacgcaaaccgacgtaccctaagacgtagggacgcgttaagacgaccggaacgtacgtacgaacctacgtaccggtaacgaacccggtaaccgaaccggttaacccttaagttttacgttaccgtaggtaccgggtaacggtaagggttacgtttaccggggtttaccggggtcggtttaccgtttcggggtttttaaccccgg

SEQ ID NO: 349784 - DNA, 656 bp, Homo sapiens
  misc_feature: GZ8MTXP02IQJNU.45.37.D04.1.454.CMB.2.raw
  modified_base (198)..(198): a, c, t, g, unknown or other
  misc_feature (198)..(198): n is a, c, g, or t
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
tcagacgcgatcgacacgaccggtgctcgatttagtagcatactgttgggtttgggggagcatcacccagcaaccacatctgtcctctagagaatcccctgagagctccgttccctcaccatggactggacctggaggatcctcttcttggtggcagcagccaacaagacgcccactcccgaggtgcagccgtgggtncgtagtcggtggggctggaggtgaggacgccgtgggctcgagtgagtctcngcaggtctngctactcctcgacggcactntccacncggtggcacgaccgaccggtcccgtaggacgtaaggtcgttggaagtggaagtgggtactgaaacctaccgaaaacccccgtagtaggtcggtacgacaaacctaaagtgacaacgaaccgtagtaacgttcggacgggacgtacgggtacaccgtagacgaacggacgaactccgtacnacgacnccagacttaccgagacgtgacgcgagacgtacgaagttacacgtaactagtaaccggtcgaaaacaccgggtaacccggttaattttaaccgtttagttaacccggtgggtaacccgtaaggttaggtaccggtttttaccgggggtaccgtttcggggttttacccgttttaaggtttttcccgg

SEQ ID NO: 349785 - DNA, 679 bp, Homo sapiens
  misc_feature: GZ8MTXP02GPBCY.45.37.D04.1.454.CMB.2.raw
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
  modified_base (352)..(352): a, c, t, g, unknown or other
  misc_feature (352)..(352): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtgggctgagtgagtctctgngagctcgtgctacnccttcgaccggcgactatcctaccacgtggtgcgacgcggcccctaggaccgaagggtctggaggtggagtgggatggactaccaaaccccccgtaanaagtcggtacgacaaacgaaactcgtagacaacgtaacgttaacggggtttcggggacgtacgggtacctaccgaagtaccgaaccggaacggtacccgaaccggtaccacgtacgaacgcgaaccgaccgtacctaacgtacggtacgggaagtccgtaggacgaccgaacgtacgttacggaaccgtacttacccggtacggaaacgacccggttaaccggtaccctttaagtttaacgttaccgttaggtacgtaaccgggaagttaacggtttccgggttacgggttcggtaccggttttacggttttacccgttttacgggg

SEQ ID NO: 349786 - DNA, 768 bp, Homo sapiens
  misc_feature: GZ8MTXP02IBYWX.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtggaaggacgccgtgggcctcgaggtgaggtctccgtgacgaggtcttcgtggctaccgtacccttacgacccggcgtaactacttccgtacctaccgtggggtgaccgaccgaccggtcccccgtaggacgaacggggtcttaggacggtgggaacggttggggtaacgtacggtaactacccgtaaacccccgtaaacgtaaggttcggggacgggtaaccaaaacctaaaacgttggtacgaaccgtaaacgtaaggttaacggtttacgggacggggtcgtaccggggtaccaaaccgtacgtacggaaacccggagggggaaccctacgttaccgaacgtaccgaacggccttaaaccggaccgtacccgtaacgtaagggtccggaacggtacggttacgaacggacgaaccggtaccgttacggaactacggttacgtacgaaaccggtaccgacgttaccgttaagttttaacccgtgtttcgggacgtaaccggtaggttacccgtttacgggttaccggtcggttttccgttttacgggttttaccgg

SEQ ID NO: 349787 - DNA, 689 bp, Homo sapiens
  misc_feature: GZ8MTXP02I15RS.45.37.D04.1.454.CMB.2.raw
tcagacgcgatcgacacgaccggtgctcgatttagtagcatactgttgggtttgggggagagcatcacccagcaaccacatctgtcctctagagaatccccctgagagctccgttcctcaccatggactggacctggaggatcctcttcttggtggcagcagccacaagagccccactcccaggtgcagctggtgcagtctggggctggaggtgaggaagccgtggggcctcagtgaaggtctcctgcaaggcttctggctacaccttcaccggcgactatcctccacgtgggtgcgaacacggcccctggacaagggcttaggagtaggagtggggatgggaactaccccgaaaaccctaaacgaaagtaggggtacggaccaaacgtaaacgtaataggaccaaacgaaggtaaaacgttttcggaaaggggtaccgtaaacggggttacccgaaacccgtaagtaccggaaacccgaaacgggggtacccaacccggtaaccctactaccgaaacgaccgaaaccacggtaacccctaaacgagttacgggacgaccgtggaaacggacaaggaacgtacgaactagtaccgacgaaccggaacgtaaccggaccttaaactttacgtaacgtggtaagacggtaagggtacgtttacggtttaccgggtcggtacgttttacggg

SEQ ID NO: 349788 - DNA, 710 bp, Homo sapiens
  misc_feature: GZ8MTXP02IPN19.45.37.D04.1.454.CMB.2.raw
  modified_base (254)..(254): a, c, t, g, unknown or other
  misc_feature (254)..(254): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactcccaggtgcagcgtggtgcagtcgtggggctggaggtggaggagccgtgggctcgagtgaggtctctgcgaggtcttcgnggctactccttcgaccggcgactactcctaccgacgtcggggtcgacgtacgaccggtccccgtaggaccgagggtcttcggaggtcggtagtaggggtagtgggaactaaccgaaacccctaaacgtaagtgggtacggaacctaaccgaaaactcgtagaccaacgtaacgttaaggtttaccggaaggggtaccgagggttaccaacgtacgtacggaaccgaacgggaactacccgtacaacgtacgacgacaacgtacgaaccgtaacgtacgttacggacgtacgtacgaacgacgtaacggtaacgcggaaacctcgtaccgttacggaaccgtaaaccggaccggttaaactaacgtttttaaccgtacggttacgtaacgggtaacggtacggttacggtttaccgggtttacggtcgggtttaccggtttcggttttttacccggg

SEQ ID NO: 349789 - DNA, 844 bp, Homo sapiens
  misc_feature: GZ8MTXP02FS73I.45.37.D04.1.454.CMB.2.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
tcagacgcgatcgacacgaccggtgctcgatttagtagcatactgttgggtttgggggagaacatcacccagcaaccacatctgtcctctagagaatcccctgagagctccgttcctcaccatggactggacctggaggatcctcttcttggtggcagcagccacaagacgcccactcccaggtgcagctggtgcagtcgngggctggaggtgaggagccgtgggctgagtgaggtcncgtgcaggtcttcgtggactactacctcgaccggcgactatccgtaccacggtgggtacgaccgacggtaccggccccgtagggaaccgaagggtccgtttaggagggttggacggttgggacttaggggaaacctaacccgtaaaaccccccttaaaggtaacgttggggtaccggaacctaaaaccgtaaaactttggtaccgaacgtaaaacggtaaccgttaagggtttaccggagggggtacccgtaacgggggttacccaaacccgttaacggtaccgggaaacccggggaacgggtaaaccccgtaacccggttccctaaacggtaacccgaaaccgggttaccaaaacccgggtaccgttaaacccttaaacggtacggggttacgggaacgttcccgaaaccgggttagggtaacaaccgggttaacaacgggtaaccttacgtaccggttaacggaaacccggccggttaaaaccccggttagttaactttttaaccggtacgtccgggttaagggaaacggtttaaccggggtttaggtttacggggttaaccccgggtttgggttacccgtttttccggggtttttaaacccgg

SEQ ID NO: 349790 - DNA, 698 bp, Homo sapiens
  misc_feature: GZ8MTXP02JKLR0.45.37.D04.1.454.CMB.2.raw
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
  modified_base (666)..(666): a, c, t, g, unknown or other
  misc_feature (666)..(666): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctggaggtgaggagccgtgggcctgagtagagtctctgagagtctgngctacncctcgacgcactacnctcagtggcgcgacgcgcccctaggacgaggtctaggagtggagtgggacgtaggactacccgtaaaccgtaacgtacggtcgggtacggaacctaaacgtaaaaccgttagtcggaaacctaacggtaaacggttaaacgttacgggaacggggacgtaaccggggtaaccaccgtaaagtaccggaaccggtaaccggggacccacgtacccaagttacccgaaagaccgaaccgaaccggtacccttaacggaaggtacggacgtaccggtaggaaccggtaacgaacgtacgtaagacccaaagttccgaaaccggtaaaccgaccgtacccggtatttaaactttacgttaccgtggtacggaaccggtaagttaggttcccgggtttacggnggtttaccgtttccggttttacgttaaccggg

SEQ ID NO: 349791 - DNA, 866 bp, Homo sapiens
  misc_feature: GZ8MTXP02HJR98.45.37.D04.1.454.CMB.2.raw
  modified_base (732)..(732): a, c, t, g, unknown or other
  misc_feature (732)..(732): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtaggaggaacgccgtggggcctcgagtagaacggtctccgtgacgaaggtcttcgtcggtcctacctacccgttaccgacccgggtaccgaacctactcctaccccgacggttggggtcgaccggtaaccggccgggtcccccgtagggaaccggtaacggggtccgtttaggggaggttacggggtaggttcgggggtaaagttacggggtaaacttaaccccgtaaaaccccccccgttaaaacgtaaacggtttacggggtaacggaacccgaaaaccgttaaaaccgtaggtaccgtaaccgtaaacccggtaaaagggttaaccggggttttaacggaaacgggggtaacccgggtaaacgggggttacccaaaaccccgttaacgggttaaccggaaacccgggaaaccgggggtaaccctacccgggttaacccaagttacccgaacgacccgaaacgtaaccgtacccgtaacgtacggtacgggacgtacggtacggacgtaacgacgtacgtanacgtagtccgacggaccggaaccgttaccgtaactttacgtttacgttaacggttcggtacggtaaccggtaggtttaacggtttaccgggtttacgggtttaccggttcggtttttccggtttttaacccggg

SEQ ID NO: 349792 - DNA, 773 bp, Homo sapiens
  misc_feature: GZ8MTXP02FJYB4.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctgaggtgaggagccgtgggctcgagtgaggtctcctgcaggtcttcgtgctactaccttcgaccggcgactactcctccgtacgtgggtcgacgaccgaccggtccccgtaggaacgaacggggtccgttaggaggtacgggaggttggggaagtagggtaacctaccgtaaaaccccccgtaaaacgtaggtacgggtacgggaacctaaaccggaaaacttcgtacgaacctaaacgtaaacggttaaacggtttacggaacggggtaccggtaaacgggggtacctaaacccgtaaggtaccggaaccggtaaaccggggaccgtaacccggtacctaaacgtccgaacgaaccctaaacgacccgtaacccgtaacgtaacggtagggtaaccgttacggacggaacgacgaacggtacgacgtaaaccgtgtacccggtaaacgtaaccggaccgtaaccgggtactttaacgttttaacgttaccgtggttacggtaacggtaaacgggtttacgtttaccggggtttaccgggttcggtttcggtttccgggtttttaaccgg

SEQ ID NO: 349793 - DNA, 589 bp, Homo sapiens
  misc_feature: GZ8MTXP02JX51T.45.37.D04.1.454.CMB.2.raw
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (277)..(277): a, c, t, g, unknown or other
  misc_feature (277)..(277): n is a, c, g, or t
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (350)..(350): a, c, t, g, unknown or other
  misc_feature (350)..(350): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagcgcccactcccaggtgcagctggtgcagtcgtgggctgaggtgaggagcgtgggctcgagtgaaggtctctgcagcttgnggctacnctcacggcgactntcnccagtggngcgacacggcccagacgaggctgngtgganggatcggactacaaccccgtaacagtggcgacgaactaacgtntgacacgtagtaacgttcgaggagacgggtaccaaccgagacggacgaacggacgaccgtacacgtacgacgacgaactacgccttaagagtcggacgtgacgagacgtagacgacgtaacgcttaccggtaacgacccggacgaccggttaccttaaagtttacccgttacgtagtacggtaacgtagggttacctttacggggttacccgggtgtttaccggtttcggttttaccgg

SEQ ID NO: 349794 - DNA, 636 bp, Homo sapiens
  misc_feature: GZ8MTXP02HBNUM.45.37.D04.1.454.CMB.2.raw
  modified_base (297)..(297): a, c, t, g, unknown or other
  misc_feature (297)..(297): n is a, c, g, or t
  modified_base (341)..(341): a, c, t, g, unknown or other
  misc_feature (341)..(341): n is a, c, g, or t
  modified_base (344)..(344): a, c, t, g, unknown or other
  misc_feature (344)..(344): n is a, c, g, or t
  modified_base (364)..(364): a, c, t, g, unknown or other
  misc_feature (364)..(364): n is a, c, g, or t
  modified_base (383)..(383): a, c, t, g, unknown or other
  misc_feature (383)..(383): n is a, c, g, or t
tcagacgcgatcgacacgaccggtgctcgatttagtagcatactgttgggtttgggggagagcatcacccagcaaccacatctgtcctctagagaatccccctgagagctccgttcctcaccatggactggacctggaggatcctcttcttggtggcagcagccaacaagacgccccactcccaggtgcagctggtgcgagtcgtgggctggaggtgagggaacgccgtggggcctcgagtggaggtctcgtgacgaggtctcgtcgctacctacctcgaccgcgactatcctaccncgtggcgccgacgcgcccgtaggacgaaggtcgtgagtggtagnggntaggactacccaaaccgtanagtggtacgacaaacagtntacgacaagacgtaagtacggaggacgacggtacaacgtacgacgaacgtacggaccaccgtactacgacgacaccaacgactacccgtagacgttacgggactcgtaacggacgacgacggtaaccgtacgtaacacgttaccacggaaaccgtaccgtaaccggtactttaacgtttacgttaccgtacggaacgtacggtaacgggttacggttacggtttacccggttacggtttcggtttttacccgg

SEQ ID NO: 349795 - DNA, 723 bp, Homo sapiens
  misc_feature: GZ8MTXP02FI8PP.45.37.D04.1.454.CMB.2.raw
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
  modified_base (283)..(283): a, c, t, g, unknown or other
  misc_feature (283)..(283): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagcctggggcctcgagtgaagtctctgcaggcttnggctacaccttnaccggcgactatctccacgtggncgacgcggtcccctggacaaggtcttagaggtggagtggggatcggacttaccaaacccctaaacgtaatggggtacggacaacgaaaactcgtacgactaacgaacgttaagtttacgaagggggcgtaacgggggtaccaaacccgaagttaccgaaaccggaaggggtaacccgaaccggttacccaagttaccgaacgaccaaaccgacggtaacccttaccgagttacgggacgtacgtacgagacgacgtacgtacggtaacctagtacgtacggtaaccggtaacccgtaaccgggtaaccctttaaatttttaccccggttaacgttacgggtttacggaaaacggggttaacggtttaacgtttaaccgggggtttttaacccggggtttaacgggttacccggtttttcgggtttttttaaaccccgggg

SEQ ID NO: 349796 - DNA, 693 bp, Homo sapiens
  misc_feature: GZ8MTXP02FLL9U.45.37.D04.1.454.CMB.2.raw
  modified_base (264)..(264): a, c, t, g, unknown or other
  misc_feature (264)..(264): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctgggtgcagtcgtggggctggaggtgaggaagccgtggggcctcgagtgaaggtctcgtgacaggcttctggctaccnccttcgaccggcgactatcctccgacgtgggtcgacgacgaccggccccgtaggaaccgaaggggtcttaggaggtggagtgggatggtactaccaaacccccgtaacgagtggtacggacaaccgaaatgtacgactaacgtaagtaagtttcggagggtacggacggggttaccaaaccgtagtaccgaacccggtaacgggtaaaccgacccgtaaccgactaccgacgtaccaaccgtacgacccgtaagaacgtacgggaacgtacgtacggacgaccgaagtaccgttacgaacgtaacgtcgtaacggaaccgtaacccgtaaccggtactttaaccgtttaacgtttaaccgtggtaccggtaaggtaacggtacgtttacggggttaccggttacggtcgttttacggtttttacccggg

SEQ ID NO: 349797 - DNA, 568 bp, Homo sapiens
  misc_feature: GZ8MTXP02FMFX4.45.37.D04.1.454.CMB.2.raw
  modified_base (236)..(236): a, c, t, g, unknown or other
  misc_feature (236)..(236): n is a, c, g, or t
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (274)..(274): a, c, t, g, unknown or other
  misc_feature (274)..(274): n is a, c, g, or t
  modified_base (332)..(332): a, c, t, g, unknown or other
  misc_feature (332)..(332): n is a, c, g, or t
  modified_base (352)..(352): a, c, t, g, unknown or other
  misc_feature (352)..(352): n is a, c, g, or t
  modified_base (439)..(439): a, c, t, g, unknown or other
  misc_feature (439)..(439): n is a, c, g, or t
tcagacgcgatcgacacgaccggtgctcgatttagtagcatactgttgggtttggggagcatcacccagcaaccacatctgtcctctagagaatccccctgagagctccgttcctcaccatggactggacctggaggatcctcttcttggtggcagcagccacaagagcccactcccaggtgcagctggtgcagtcgtgggctgaggtgaggagccgtggggcctcagtgaggtcnctgcagctntgctacnctcncgnactancncagtggtncgacacggccctggacagggtcttggagtggagtgggatggactaccaaacccctaanagtggtaggacaacaaactntacgacaacgtaagtaagtttacgaggggacgtagggtaccaccagtcgacgacggaccacgtccagtcacgcaacgacgacctaangtacggagcgtagacgacgaagtacctagaactagttcgtacggaaccgtacgaccggtaccttaagtttactacgtgtcggaacgtaggtacgttacggtttacggtcggttcgtttcggttttccgg

SEQ ID NO: 349798 - DNA, 634 bp, Homo sapiens
  misc_feature: GZ8MTXP02JSNN7.45.37.D04.1.454.CMB.2.raw
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (308)..(308): a, c, t, g, unknown or other
  misc_feature (308)..(308): n is a, c, g, or t
  modified_base (367)..(367): a, c, t, g, unknown or other
  misc_feature (367)..(367): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggacgcgtgggctnagtgagtcnctgcagctntgctacncctcgaccggctactatctcgactgggtgcgacgcggcccctggacaggggtctaggngtggatggggatggaactacaaccccccgtaagaacgtgggtacgactaacgtaaactnttaccaacgtaagttaagttcgaacggggtcgaacggggtacaacccgttaagacggacccgaaggggaaacccttacgccaactcgaacgctaacgtacgcctaagacgtagacgtcgtaagcgacctaaggactacggaactacgtcgaacgggtacccacggaacccgtacctttaattttaaagtccgtaggtaccgacggtaaggtaacgtttcggtttaaacccggggtgttccgttttcccggggttttaatttccgggg

SEQ ID NO: 349799 - DNA, 615 bp, Homo sapiens
  misc_feature: GZ8MTXP02I4VHF.45.37.D04.1.454.CMB.2.raw
  modified_base (254)..(254): a, c, t, g, unknown or other
  misc_feature (254)..(254): n is a, c, g, or t
  modified_base (516)..(516): a, c, t, g, unknown or other
  misc_feature (516)..(516): n is a, c, g, or t
  modified_base (581)..(581): a, c, t, g, unknown or other
  misc_feature (581)..(581): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaggtctctgcaggtcttcgnggctacaccttcgaccggcgtactactcctccacgtgggtgccgacgaccggccccgtggaacgagggtcttaggacggtggaagtggggtatagggacttaccaaaaccccccgtaagaagtcggtacggactaacgaaactgtcgactaacgtaagttacgttacggacgggcgtacgggtcaaaccgtagtccggaaccggagggtacaccgtcagtacgagaccaaacgccgacctacgagtcgggacttcgagaacncgaacgcttaggacctagttcccgaaggacccgtacgacgttacttaatttacgtcgtgtacggngtagtcgttacggtcgtcgtttcgttacgtttcg

SEQ ID NO: 349800 - DNA, 748 bp, Homo sapiens
  misc_feature: GZ8MTXP02G30M2.45.37.D04.1.454.CMB.2.raw
  modified_base (225)..(225): a, c, t, g, unknown or other
  misc_feature (225)..(225): n is a, c, g, or t
  modified_base (248)..(248): a, c, t, g, unknown or other
  misc_feature (248)..(248): n is a, c, g, or t
  modified_base (272)..(272): a, c, t, g, unknown or other
  misc_feature (272)..(272): n is a, c, g, or t
  modified_base (325)..(325): a, c, t, g, unknown or other
  misc_feature (325)..(325): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctggaggtgaggagcgtgggctnagtgacgtctcctgcgagcttcnggctaccaccttcaccggcgactntcctccacgtggtcgcgacgaccggccgtgaacgaaggtctaggaggtggagnggatacggactaccaaaccccgtaaacgtaacgtggtacggaacaaccgtaaacttacgcgactaaacgtagtaaacggtttcgaaacggggtacgaaccggggtacaaaccgtacgtaaccggaaaccggtaaacggggacccgttacccggtaaccggtaacctaccggaaccggtaaaccctaaccccgaaacggtaaacccgttaaccggtaaggttacgggtaaacgcggtacggaaccgaaccggttaaaacgggcccttaaacggaacctcgttaacccgacggtaaaacccggaaccgtaacccggtaacccttaaacttttaacgttaccggttaggtccggtaaccgggtaagggttacgttttaacgggtttaccggggtaccgggtttcgttttacgggttttttcccggg

SEQ ID NO: 349801 - DNA, 598 bp, Homo sapiens
  misc_feature: GZ8MTXP02FRQSO.45.37.D04.1.454.CMB.2.raw
  modified_base (432)..(432): a, c, t, g, unknown or other
  misc_feature (432)..(432): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaggtctcctgcaggcttctggctacaccttcaccggcgactatcctccacgtggtcgcgacgacggccccgtaggaacgagggcttggagtggaagtgggatggactaccaacccctaacgagtggtacgacaacaactgtcacagtaagtagttacgagggcaggtcacgagtacgacgagacacgtacagcacgcanacgacctaagagtagggacgacgtacggagacgacgtacgtagaactacgtacgtacgacgtaccgaccggtaaccttaaagttttacgttacgtaggttacggaacggttaacggtacgttttacggggttaccggtggttaccggtttacggtttttacccggg

SEQ ID NO: 349802 - DNA, 636 bp, Homo sapiens
  misc_feature: GZ8MTXP02FQ466.45.37.D04.1.454.CMB.2.raw
  modified_base (198)..(198): a, c, t, g, unknown or other
  misc_feature (198)..(198): n is a, c, g, or t
  modified_base (293)..(293): a, c, t, g, unknown or other
  misc_feature (293)..(293): n is a, c, g, or t
  modified_base (359)..(359): a, c, t, g, unknown or other
  misc_feature (359)..(359): n is a, c, g, or t
  modified_base (384)..(384): a, c, t, g, unknown or other
  misc_feature (384)..(384): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactccccaggtgcagctggtgcagtcgnggggctggaggtgaggaagccgtggggcctcagtgaaggtctctgcaggcttcgtggcctacaccttcaccggcgactatcctaccacgtgggtnacgaccgacggccccgtggaacgaagggtctggagtggacgtgggatggactaccaaccccgtaanaagtggtacgacaaccaaagttcgngaccaagtaagtaacgtttacggaacgggtcgaacgggtcctaaacccgagacggaaccgaacgggggacccaaccggtccaagtcgaaacgacaaaccgtacggccttaacgaacggttggaacgtcgacgacgtacgaaggtaccgtacgaatacgtacgtacggaccgacgaccggaccttaagtttacttaaccgtgttacgaacggtaagtcggtttacggttaccggtgtcgtttacgttttccgg

SEQ ID NO: 349803 - DNA, 697 bp, Homo sapiens
  misc_feature: GZ8MTXP02HRYET.45.37.D04.1.454.CMB.2.raw
  modified_base (222)..(222): a, c, t, g, unknown or other
  misc_feature (222)..(222): n is a, c, g, or t
  modified_base (229)..(229): a, c, t, g, unknown or other
  misc_feature (229)..(229): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagacgcccactccccaggtgcagctgggtgcagtcgtggggctggaggtggaggagcgngggcctnagtgaaggtctccgtgcaaggtcttcgtggctacctaccttcaccggcgactactcctccacgtgggtcgcgacgacggcccccgtggaacgaacggggtcttggaggttggagttagggagttaggactaaccaaccccccgtaaacaaagttggacggacaaaccgaaattacgcgacgaaaccgtaaggttaaaggtttaccggaacggggtacgaccgggggttaccaaacccgtacgtaacggaacccgggaaggggacccaaccggttaccctaacgtaccacggaacctaaccgacgtaccgttaacgtaggttacggagcccgtaggacacgtaaccgagtacgaactaacgtcgtaacgaccgaacgtaccgtaccttaaattttacgtacgttcggtacgtaacggttaggtaacgtttccgggttacggtcggtttccgtttcggtttttaacccgg

SEQ ID NO: 349804 - DNA, 638 bp, Homo sapiens
  misc_feature: GZ8MTXP02IIOJP.45.37.D04.1.454.CMB.2.raw
  modified_base (227)..(227): a, c, t, g, unknown or other
  misc_feature (227)..(227): n is a, c, g, or t
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
  modified_base (288)..(288): a, c, t, g, unknown or other
  misc_feature (288)..(288): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccaacaagagcccactcccaggtgcagctgatgcagtctggggctggaggtgaggaagccgtgggcctnagtgaagtcncctgcaagctcgngctacaccttcaccggcactatcctaccacgtgggtcncgacacggccccgtaggacctaagggtcttaggagtggagtgggatggaactaccccaaaccgtaacagtcgggtacgaacaaacgtaacgttatacggacaaacgtaaggttaactttacgacggggactacggggtacaaccacgtacggaaccgtacggacctaaccgtaccgaatcgaacgaccaacgtaccgaccttaacgagtacggggaactcgtacgacgacgagtaactcgaactaacttcgaacgaccggtactaacgggtacccttaaagtttaccgttaagtcggtaagacggtaacggttacgttacggtttaccgggtcggtttacgttttccggg

SEQ ID NO: 349805 - DNA, 625 bp, Homo sapiens
  misc_feature: GZ8MTXP02FE6YK.45.37.D04.1.454.CMB.2.raw
  modified_base (232)..(232): a, c, t, g, unknown or other
  misc_feature (232)..(232): n is a, c, g, or t
  modified_base (256)..(256): a, c, t, g, unknown or other
  misc_feature (256)..(256): n is a, c, g, or t
  modified_base (291)..(291): a, c, t, g, unknown or other
  misc_feature (291)..(291): n is a, c, g, or t
  modified_base (369)..(369): a, c, t, g, unknown or other
  misc_feature (369)..(369): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagacgcccactcccaggtgcagcgtggtgcgagtcgtggggctgaggtgaggagccgtggggcctnagtgaggtctcctgcaggtcttcnggctacacctcaccggcactatctccagttgggcncgaccgacggcccctaggacgacgggtcttggaggtggggagtaggggagtacggactaccccaaaaccccgttaaanaagtgggtacggacaaacaactagtcgacacgaagtagtttcgagggacgaggtaccacagtacgaacccggaagaccacgtaccagacgagaccacacgaccttacgagtagggatccgtagagacgagtacagactaccgtagtaaccggacggtaacccgaccggttaccttaagttttaacttaccgtagggtaacgcggtaaaggttacggttacggttttaaccgggcgggtttacggtttttcccgggg

SEQ ID NO: 349806 - DNA, 602 bp, Homo sapiens
  misc_feature: GZ8MTXP02IWZQD.45.37.D04.1.454.CMB.2.raw
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (380)..(380): a, c, t, g, unknown or other
  misc_feature (380)..(380): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctgaggtggaggagcgtgggcctgagtgagtctctgcagtcttcgnggctacnccttcgaccggctactactcctccgacgtggtcgcgacgacggtccccgtaggaacgagggtcttggaggtggagtgggatggactaccaaacccctaagagtggtacgacaaacgaaactgtanacaacgtaagtacgttaggacgggcgtacggtaccaactagtaccggaccgaagggtactaccgtacacgtacacgactaaccgacgacctacgagacggacgtcgacggagacgtagaactagaacgtactcgaacggacgaaccgacggtacttaagtttactacgtgtacgaacgtaggtacgttacgggttacgtcggttacgtttcgtttttaccgg

SEQ ID NO: 349807 - DNA, 617 bp, Homo sapiens
  misc_feature: GZ8MTXP02IZZUZ.45.37.D04.1.454.CMB.2.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
  modified_base (284)..(284): a, c, t, g, unknown or other
  misc_feature (284)..(284): n is a, c, g, or t
  modified_base (339)..(339): a, c, t, g, unknown or other
  misc_feature (339)..(339): n is a, c, g, or t
  modified_base (358)..(358): a, c, t, g, unknown or other
  misc_feature (358)..(358): n is a, c, g, or t
  modified_base (451)..(451): a, c, t, g, unknown or other
  misc_feature (451)..(451): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctnagtgaagtctctgcaggcttntggctacaccttcaccggcaactactccccatcgggtncgacacggcccctggacaaggctggacgtggagtgggatggactacgaaccctanaagtggtgacactaaactntgacaacagaacgttcgagggcacggggtcaccgtagacgaccgagggaccacgtccgaatcgagacaacgtacgacctaacgacgtacgganaccgtagaacggaccaggtaacctggaactacgttacgacggaacgaccgtaccggtacccttaaagttttaacttaccgttaaggcccggtaacggtaaggttaacgttaccggttttaaccgggtacggttcccgttttagggttttacccctttttaacgggg

SEQ ID NO: 349808 - DNA, 640 bp, Homo sapiens
  misc_feature: GZ8MTXP02H0MHX.45.37.D04.1.454.CMB.2.raw
  modified_base (256)..(256): a, c, t, g, unknown or other
  misc_feature (256)..(256): n is a, c, g, or t
  modified_base (262)..(262): a, c, t, g, unknown or other
  misc_feature (262)..(262): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctgggaggatcctcttcttggtggcagcagccacaagacgcccactcccgaggtgcagcgtggtgcaggtcgtgggctggaggtggaggagcgtgggcctcgagtgaggtctctgacacgtctcgngctacnctcaccgcactatcctcacgtggtgacgacgcggcccgaggaacgaggtcttaggaggtaggtagtgggagtcggactacctaaaccccgtaagtacgttggtacggacaaactaaactgacgacaacgtaggttaagttcgacgggtacgacggtacaacgagtacggaaccgacgggaaacctacccggtacctacgacgacgaccgaaacgtacgtacctaacgtaagtacgggacgtacgacgacgacgaacggactaacggactaacgtcgtacggaccgacgtacggtaccttaacgtttactacgttggtaccgtaaggtacggttaacggtttcggtttacggtcggtttacggtttcggtttttaccgg

SEQ ID NO: 349809 - DNA, 665 bp, Homo sapiens
  misc_feature: GZ8MTXP02IOLY9.45.37.D04.1.454.CMB.2.raw
  modified_base (259)..(259): a, c, t, g, unknown or other
  misc_feature (259)..(259): n is a, c, g, or t
  modified_base (393)..(393): a, c, t, g, unknown or other
  misc_feature (393)..(393): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactccccaggtgcagctggtgcagtcgtgggctggaggtgaggaagccgtgggcctcgagtgaaggtctctgcagtcttctggctacnccttcgaccggcgactatccctccacgtgggtcgcgacgacggccccgtaggaacgaagggtccttaggaggttggagtgggtagtggtaactaccaaaacccccgtaagagttggtaggacaaactaaacgtntcgacaaacgaagtacgttcgaagggtcagggtcacgatacgacgaagggactacgtaccatacgacgacaacgacgtacctaaacgtagtacggagtacgtagacgacgtaacgtacgttagaaccgtacgttacgaaccggtaaaccgaaaccgtaccgggtaaaccttaacgtttttaacgtaccgttaggtacggtaacggtaacgggttacggttttacgggtttaacgggttccggtttacggtttaccgggttttttaacccggg

SEQ ID NO: 349810 - DNA, 589 bp, Homo sapiens
  misc_feature: GZ8MTXP02G3IK2.45.37.D04.1.454.CMB.2.raw
  modified_base (422)..(422): a, c, t, g, unknown or other
  misc_feature (422)..(422): n is a, c, g, or t
  modified_base (449)..(449): a, c, t, g, unknown or other
  misc_feature (449)..(449): n is a, c, g, or t
  modified_base (471)..(471): a, c, t, g, unknown or other
  misc_feature (471)..(471): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaagtctcctgcaaggcttctggctacaccttcaccggcgactatctccactgggtgcgacgcggcccctggacaagggcttgaggtggagtgggatggactacaaacccccgtaacaagtggtaggacaacctaaaacgtctcgacaaccgaagtaaagtttcgaagggggtacacggggtccaaacccganacggaaccgaaggggacaccgtcaacncgacgacacagtcctaacgagnggaagtcgcgacgacagtaacctaggaaccatccgagtaaccgacgacggtacctatttaactacgtggtgaaccgaggtaacgttacggtttacggcggttacgttcggttttaccg

SEQ ID NO: 349811 - DNA, 533 bp, Homo sapiens
  misc_feature: GZ8MTXP02JN5WQ.45.37.D04.1.454.CMB.2.raw
  modified_base (327)..(327): a, c, t, g, unknown or other
  misc_feature (327)..(327): n is a, c, g, or t
  modified_base (341)..(341): a, c, t, g, unknown or other
  misc_feature (341)..(341): n is a, c, g, or t
  modified_base (346)..(346): a, c, t, g, unknown or other
  misc_feature (346)..(346): n is a, c, g, or t
  modified_base (358)..(358): a, c, t, g, unknown or other
  misc_feature (358)..(358): n is a, c, g, or t
  modified_base (454)..(454): a, c, t, g, unknown or other
  misc_feature (454)..(454): n is a, c, g, or t
tcagacgcgatcgacacgaccggtgctcgatttagtagcatactgttgggtttggggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacgacgcccctggacaagggtctggagtggatgggangatacaaacccaanagtgngacaacaaactncgacaacgaagtaagttacgacggacgacgtacaacatacgacgaaggaacgacgacacacacacgacacactacagagagacgagagacagacanacacacgtacgacgacgacgtactaacttacttactagtagtaacgagtacgttacgttacggtacgtcgttcgtttcg

SEQ ID NO: 349812 - DNA, 710 bp, Homo sapiens
  misc_feature: GZ8MTXP02FOI9L.45.37.D04.1.454.CMB.2.raw
  modified_base (250)..(250): a, c, t, g, unknown or other
  misc_feature (250)..(250): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtgggcctgagtgaggtctcctgcagcttcnggctactacctcaccggcgactactctccacgtgggtgccgacgccggcccctaggaccgaaggggtcttaggaggtgggagtcgggagtggactaccgaaacccccgtaagaagtgggtacggacctaaacgtaaaacgttgtcgaccgaaacgtaaaggttaacggtttcggaacggggtaccggtacggggtaccaaccgtagtaacggaccgaagggacctaccgtaccactcgacgcgacacgtacctacgagtacgggacgaccgtaggaaccacgtaacggtacgacggaacctacgttaccggaacgaacccggtaaccggaaaccggttaccctttaaagttttaccgtttaaacggtcggttacgggaaccgggttaaacggggtttacgttttacgggggttttaaccggggttcgggtttaccggtttttcggttttttaccccgggg

SEQ ID NO: 349813 - DNA, 576 bp, Homo sapiens
  misc_feature: GZ8MTXP02JGCZ3.45.37.D04.1.454.CMB.2.raw
  modified_base (266)..(266): a, c, t, g, unknown or other
  misc_feature (266)..(266): n is a, c, g, or t
  modified_base (358)..(358): a, c, t, g, unknown or other
  misc_feature (358)..(358): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtggaggaacgccgtggggcctcgagtggaaggtcctcctgcaggcttcgtggctacnccttcaccggcactactcctccacgtgggtgcgacacggccccctggacgaagggcttaggaggtggatgggatggataccaaaccccctanaagtggtggacaacaaactgtacgacaacgagtagttcgagggtcgaaggtcaaccagacgacgagggacacgtccatcagcatacgcctaacgagtggacgtcgagagcaagtaccctgacagtcgtacgaccggaaccgaccggtaccttaggtttactacgtaggttacgcggtagtacgttacggttccggtggttccgtttggtttttacccg

SEQ ID NO: 349814 - DNA, 900 bp, Homo sapiens
  misc_feature: GZ8MTXP02H6JPP.45.37.D04.1.454.CMB.2.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagctggtgcaggtcgtggggctggaggtggaggaacgccgtcggggcctcgagtagtacggtctccgtgacgtacggtcttacgtcggacctaacctacccgttaccgaccgggactacctactcctccgtacgtcggggtcaccggaccggacccggtccccgtagggaacgtacggggttccgttaggtacgggtagggtacggtggggtaacgtcggggtaaaccttaacccgtaaaacccccgttaaaacgtaagggttacggggtaccggacctaaaaaccgtaaaacgtttacgtaacgtaaccgtaaaacgggtaaacgggtttaaaccgggtttaccgggggaaaccgggggtaaccgggtaaccgggggttaaccctaaaccccggttagtaaacccgggggaaacccggaaccggggttaaacccgtacccggttaacccgtacgttaacccgaaacggacccctaaaccgggtaaaccttaccccgtaaaaggtcgggttacgggaccgttaccggtaaaggaccgaacgtaaccggtaacggttacaaaccgtaccgttaccggtaaaccgaaacccggtaccggtaacccgggtttaacctttaaagggtttacttaccggtggtaaccggtaacggttacggttaaacggttttcccgggggttaacggtttcggtttccggtttaaccggtttttccccgg

SEQ ID NO: 349815 - DNA, 615 bp, Homo sapiens
  misc_feature: GZ8MTXP02F4A4B.45.37.D04.1.454.CMB.2.raw
  modified_base (200)..(200): a, c, t, g, unknown or other
  misc_feature (200)..(200): n is a, c, g, or t
  modified_base (251)..(251): a, c, t, g, unknown or other
  misc_feature (251)..(251): n is a, c, g, or t
  modified_base (290)..(290): a, c, t, g, unknown or other
  misc_feature (290)..(290): n is a, c, g, or t
  modified_base (372)..(372): a, c, t, g, unknown or other
  misc_feature (372)..(372): n is a, c, g, or t
  modified_base (435)..(435): a, c, t, g, unknown or other
  misc_feature (435)..(435): n is a, c, g, or t
  modified_base (463)..(463): a, c, t, g, unknown or other
  misc_feature (463)..(463): n is a, c, g, or t
  modified_base (593)..(593): a, c, t, g, unknown or other
  misc_feature (593)..(593): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggagatcctcttcttggtggcagcagccacaagagcccactcccaggtgcagcgtggtgcagtcgngggctggaggtgaggagcgtgggcctgagtgagtctctgacaggtcttcgngctacaccttcaccggcactactcctcgacgtgggtacncgacgacggccccgtggacgaagggtctgaggtggagttgggatggactaccccaaaccgtaacagtggtacgacaacatancgtaacacgagtaacgttcgacgggacagggtccaaaccagtacggacgaggaccacgtacanaccacgaccaacgacgtacccagtacgngggaaacgcgtaaggacccgtagaacgatacgacgcgttaacgacggaaccgtaccgaccggttactttaaccgtttatacggtttagaacggtaccggtaaggtttacgttacggggttttaacccggngggtttcccgtttttaccgggg

SEQ ID NO: 349816 - DNA, 630 bp, Homo sapiens
  misc_feature: GZ8MTXP02FSMS4.45.37.D04.1.454.CMB.2.raw
  modified_base (223)..(223): a, c, t, g, unknown or other
  misc_feature (223)..(223): n is a, c, g, or t
  modified_base (361)..(361): a, c, t, g, unknown or other
  misc_feature (361)..(361): n is a, c, g, or t
  modified_base (380)..(380): a, c, t, g, unknown or other
  misc_feature (380)..(380): n is a, c, g, or t
  modified_base (459)..(459): a, c, t, g, unknown or other
  misc_feature (459)..(459): n is a, c, g, or t
  modified_base (486)..(486): a, c, t, g, unknown or other
  misc_feature (486)..(486): n is a, c, g, or t
  modified_base (497)..(497): a, c, t, g, unknown or other
  misc_feature (497)..(497): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggagatcctcttcttggtggcagcagccacaagagcccactcccaggtgcagctggtgcagtcgtgggctgaggtggaggagcgtgggctnagtgaggtctctgcaggcttcgtggacctacaccttcgaccggcgtaactcttccgtccacgtgggtcgacgacgacggtccccgtaggaccgaaggtcgttggaggtggagtggggagtgaactaccaacccctaanagtggtcgacaacgaactngacacgaagtacgttacgagggtactagtactaccgaacctagtacccggaaccgtacgggaacctacgtaacctacanaccgaacaccgtaaccggaccttacgngtacggggaanacgacgacgacgaagtaccacgacgtacgtaccggaacggaccgtaacctacggttactttacgttacgttacgtacggtaacggtacggtacggttcggttacgggtttcggttacggttacggttttacgg

SEQ ID NO: 349817 - DNA, 570 bp, Homo sapiens
  misc_feature: GZ8MTXP02JRO2A.45.37.D04.1.454.CMB.2.raw
  modified_base (297)..(297): a, c, t, g, unknown or other
  misc_feature (297)..(297): n is a, c, g, or t
  modified_base (362)..(362): a, c, t, g, unknown or other
  misc_feature (362)..(362): n is a, c, g, or t
tcagacgcgatcgacacgaccggtgctcgatttagtagcatactgttgggtttggggagcatcacccagcaaccacatctgtcctctagagaatccccctgagagctccgttcctcaccatggactggacctggaggatcctcttcttggtggcagcagccacaagagcccactcccaggtgcagctgtgcagtctgggggctgaggtgaggaagcctggggcctcagtgaaggtctcctgcaaggcttctggctacaccttcaccggcgactacgtctcccactgggtgcgaacgnggccccctggacaagggcttcgagtggactggatggatcaacccctacatggtgacacaacttancacgacagaatttcgagggcaagggtcaccgatgacccgaaggggcacggtcaacgcgacgacaacgacgtcctactataccgggagcgtagacgacgacgacgtacgacgtacgtacgtacgacgacgacgtaccgtacgtttacgttacgttacgtacgtaacggtacggtacgttacggttaccggtacggtcgttacggtttcg

SEQ ID NO: 349818 - DNA, 592 bp, Homo sapiens
  misc_feature: GZ8MTXP02IX02A.45.37.D04.1.454.CMB.2.raw
  modified_base (256)..(256): a, c, t, g, unknown or other
  misc_feature (256)..(256): n is a, c, g, or t
  modified_base (400)..(400): a, c, t, g, unknown or other
  misc_feature (400)..(400): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
tcagacgcgatcgacacgaccggtgctcgatttagtagcatactggttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggacgcctggggcctcgagtgaaggtctcctgcaagtctttcnggctacgaccttcgaccggcgactacgtcctccaccggtgggtgccgacgcggtcccctaggggaaccaggggttcaggacggtaggaggttgggaacttgggacttcccgaaaacccgtactaagtcggtagactaacaactncgacacgtagagttcgagggtcaggcacgntacggacgaaggcncgtaccaagcacgacacacgactaccgagtcggtagctagacgaccgaggtacagaccagttcgacgacgttaccacgggttccttaaggttaacctttcggagtacgtaacgacggttacgttacgtacgtcggtcgttacgtttcg

SEQ ID NO: 349819 - DNA, 592 bp, Homo sapiens
  misc_feature: GZ8MTXP02JWQC3.45.37.D04.1.454.CMB.2.raw
  modified_base (295)..(295): a, c, t, g, unknown or other
  misc_feature (295)..(295): n is a, c, g, or t
  modified_base (362)..(362): a, c, t, g, unknown or other
  misc_feature (362)..(362): n is a, c, g, or t
  modified_base (389)..(389): a, c, t, g, unknown or other
  misc_feature (389)..(389): n is a, c, g, or t
  modified_base (482)..(482): a, c, t, g, unknown or other
  misc_feature (482)..(482): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcaaggcttctggctacaccttcaccggcgactatctccactgggtgcgacncggcccctagggacaagggtcttaggacgtggactggggattagggactaccaaaccccccgttaanagtacgggtacggactaactaaacgtntcgacacgaagtaacgtttcgaagggtacgaggggtaccaccgtagcgaaccgagggacacgtccaagcagctagacgtacacagtggaacgngagacgactaagactacgtacacgtcgacggtacgacctacggtacttaagttacgtacgtgtacgaacgtagttacgttacggttacggtcgttacgtttacggtttcg

SEQ ID NO: 349820 - DNA, 590 bp, Homo sapiens
  misc_feature: GZ8MTXP02JJL1K.45.37.D04.1.454.CMB.2.raw
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (341)..(341): a, c, t, g, unknown or other
  misc_feature (341)..(341): n is a, c, g, or t
  modified_base (358)..(358): a, c, t, g, unknown or other
  misc_feature (358)..(358): n is a, c, g, or t
  modified_base (412)..(412): a, c, t, g, unknown or other
  misc_feature (412)..(412): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagacgcccactcccaggtgcagcgtggtgcagtcgtggggctggaggtgaggaagccgtgggcctcagtgagtctcgtgacaggtcttgngctacnccttcgaccggcgactancctccagtggtcncgacncggcccctggacgaggctgaggtcgagtggatggactacaacctaanagtgtgacaacaaactntcgacaacagtacgttcgagggcaggtacacgagtcgacgaggacacgtaccanacgacgaccacgactcctaagtacgtacggagacgtaggaacgacgacggaccgtagaccgtaactcgaacgaccgacgtacgttacctaaagttttactacgtcgtacggtacgtcggtaacgtttacgggtttaccgggtgtttaccggtttcggtttacgttttaaacccggggg

SEQ ID NO: 349821 - DNA, 644 bp, Homo sapiens
  misc_feature: GZ8MTXP02JGPEV.45.37.D04.1.454.CMB.2.raw
  modified_base (380)..(380): a, c, t, g, unknown or other
  misc_feature (380)..(380): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccgaggtgcagctggtgcagtcgtggggctggaggtgaggagcgtgggcctcgagtgaaggtctcgtgcaaggtcttcgtggccttacacccttcaccggcgactagtcctccacgtgggtcgcgacgcggccccgtaggacgaagggtctaggagtggagtgggatggactaccaaacccccgtagagtggagacaacgaagtntgacctagagtaagttcgagggcgtacggcaaccagtcgaacgacggacaccgtccaagtacacgacaaccgagtacccgtaacgagtgggacgtactagggaacgacgacggtaacgtccgaaaacgtcgttacgacggtaaccggtaacgaacccggtaccctttaaatttttaccgtaaccgttggggtaccgtaacggtaacggttaacgttccggggtttaaccgggtggtttacccggttttcgggtttttaccccgg

SEQ ID NO: 349822 - DNA, 669 bp, Homo sapiens
  misc_feature: GZ8MTXP02I8JR3.45.37.D04.1.454.CMB.2.raw
  modified_base (250)..(250): a, c, t, g, unknown or other
  misc_feature (250)..(250): n is a, c, g, or t
  modified_base (269)..(269): a, c, t, g, unknown or other
  misc_feature (269)..(269): n is a, c, g, or t
  modified_base (280)..(280): a, c, t, g, unknown or other
  misc_feature (280)..(280): n is a, c, g, or t
  modified_base (341)..(341): a, c, t, g, unknown or other
  misc_feature (341)..(341): n is a, c, g, or t
  modified_base (369)..(369): a, c, t, g, unknown or other
  misc_feature (369)..(369): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaagtctctgcagcttngctacacctcacgcgatanctcacgtggtncgacgaggccctaggacaggcttagagtggagtggggatcggactacaaaccccccgtaanaagttgggtacggacaaacaaaccgttntcgggaacctaaccgtaagtaacgggttttaccgaagggggtacccgtacgggtacgaaacccgtacgttacggaacccggtaacggggaacccacccggttaccacgtaccgacggaccaaacgaccggtaccctaaccgtagttaccgggagacgtacgacgtacaacggtaactgacgtacgtactaacggaccggaacgtacgggtacctaaacggttttacttacgtaacggttggaacccggttaggtaccgttacgggtttacccgggtggtccggtttcggttttttcccgg

SEQ ID NO: 349823 - DNA, 553 bp, Homo sapiens
  misc_feature: GZ8MTXP02FO01G.45.37.D04.1.454.CMB.2.raw
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
  modified_base (504)..(504): a, c, t, g, unknown or other
  misc_feature (504)..(504): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagccccactcccaggtgcagctggtgcagtctggggctgaggtgaggagcgtgggcctnagtgaggtctcctgcaggtcttcgnggctacaccttcgaccggcgactatcctccacgtgggtncgacacggcccctggacaggctgaggtaggatgggatgaactacaaccgtaaacaagttggagacaactaaacgtatcgacaacgtagtaacgttcgagggacgtacgggtacacgagtacgaacgaggacacgtcagtacgagacacgacacctaacgagtgacgtcgagaccgcaagtacacacactcgagaccgacacgtactatttacgtacngtcgagaaggtacgttacgttacggtgttacgtttcggtttctttacgg

SEQ ID NO: 349824 - DNA, 625 bp, Homo sapiens
  misc_feature: GZ8MTXP02I95EU.45.37.D04.1.454.CMB.2.raw
  modified_base (251)..(251): a, c, t, g, unknown or other
  misc_feature (251)..(251): n is a, c, g, or t
  modified_base (447)..(447): a, c, t, g, unknown or other
  misc_feature (447)..(447): n is a, c, g, or t
  modified_base (482)..(482): a, c, t, g, unknown or other
  misc_feature (482)..(482): n is a, c, g, or t
  modified_base (503)..(503): a, c, t, g, unknown or other
  misc_feature (503)..(503): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggctcagtgaaggtctcctgcaaggcttnggctacacttcaccggcgactatctcacgtggtgcgacacggccccgtggaacaagggtcttaggagtggagtgggaattggataccgaaacccctaacaagtcggtggacaaacaacgtatgacaaacgtaagtaagttacgacggggtacaggggtaccactaacggacgaacgaacgggacgtaccgtcaacncgacgactacgaccaccgtaaacgagtcgggaacnccgtaagacggaccaaggtcncggaaactggactacggaaccgaccgtaaccggcttaaactttttaagacttacggttccggaagtaaccggttagttacggtttaaccccggggaggttacccgtttgggtttttaacccg

SEQ ID NO: 349825 - DNA, 633 bp, Homo sapiens
  misc_feature: GZ8MTXP02ICA5O.45.37.D04.1.454.CMB.2.raw
  modified_base (223)..(223): a, c, t, g, unknown or other
  misc_feature (223)..(223): n is a, c, g, or t
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (286)..(286): a, c, t, g, unknown or other
  misc_feature (286)..(286): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (385)..(385): a, c, t, g, unknown or other
  misc_feature (385)..(385): n is a, c, g, or t
  modified_base (501)..(501): a, c, t, g, unknown or other
  misc_feature (501)..(501): n is a, c, g, or t
tcagacgcgatcgacacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaagagcccactccccaggtgcagctggtgcagtctggggctgaggtgagagctgggctnagngaaggtctctgcaggctctggcacnccttcaccgggtcactaatctacccgaagttgggnccgtaaacgcggcccccttggaacctaagggtcttggaagtggtaagcggggatgggactacgaacccccctaaaanaagtggnggacaacctaaattnggaccagtaagaaacgtttccgaaagggcacggggttacacccatttcggaacccaggggaccttaacggcccgaattccaaggcacaacggggtttcccagttaagcgggaaccncgttagagacgacgactacgacgtactacgtacgacgacgtaccgtaccgttaacgtttaacgttacgttacgtacggtaacgtacggtacgttacggtttaccgggttacggttacgtttacggtttaccg

SEQ ID NO: 349826 - DNA, 700 bp, Homo sapiens
  misc_feature: GZ8MTXP02I4W8E.45.37.D04.1.454.CMB.2.raw
  modified_base (598)..(598): a, c, t, g, unknown or other
  misc_feature (598)..(598): n is a, c, g, or t
tcagacgcgatcgacacgaccggtgctcgatttagtagcatactgttgggtttgggggcatcacccagcaaccacatctgtcctctagagaatccccctgagagctccgttcctcaccatggactggacctggagatcctcttcttggtggcagcagccaacaagacgcccactcccgaggtgcagctggtgcgagtcgtggggctaggaggtgacggaacgccgtacggggccttacgaggttgaacgttcctccgtgacgtaacggtcttcgtacggtccttacctacccgttccgaaccggtctaaccttctcccgtaccgtaacggtcggggtcgaccgaacccgccgggtacccccgtagggaaccgtaggggtcttggggaaacggttggaggtgggagtacggtactaccgaaaccctaagtaacggtcgggtacaaccaactaaacgttgacgtacaagtacgtagttaccgaggtacgacggttcaaaccgtagaccgaacggtacggtacgtacctaccaagtaccgaacgccaactttacggaacccttaagacgttcggagtccgagaacgcggttaacgcgtaanacgtacgtacgaacgaaccgaccgtacgttaacttagttacgtcgtagtcggacgtaaggttcgttacgtttacggtcgttccgtttacggtttacgtacgg

SEQ ID NO: 349827 - DNA, 743 bp, Homo sapiens
  misc_feature: GZ8MTXP02GHDEG.45.37.D04.1.454.CMB.2.raw
  modified_base (331)..(331): a, c, t, g, unknown or other
  misc_feature (331)..(331): n is a, c, g, or t
  modified_base (383)..(383): a, c, t, g, unknown or other
  misc_feature (383)..(383): n is a, c, g, or t
  modified_base (568)..(568): a, c, t, g, unknown or other
  misc_feature (568)..(568): n is a, c, g, or t
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagagcccactcccaggtgcacgcgtggtgcagtcgtagggctggaggtgaggaacgccgtggggcctcgagtgtaggtctccgtgcaacggtcttcgtggtacctacaccgttccgaaccgggctaaccttaacgtccctacctaacgtggggtacgacgtaccnccggacccgttggaacgtaacgggtcctttagggaggtagggtacttagggngttacggacctacccgtaaaacccccgttaaagaatcgggggacaccaaacgttaacgtcgtaacgtaccgtaacgaagtaaagtttcccggaagggtacgtacggggttaccaacgttacacggtaaaccgaggggtaccttaaccgaccgtatacgaacgacctaacggataaccccggttanaagacgggttaagcccgttagaaggtcccttaaaacgggactaaccgggtacaacggggtttaccaaaacgggtttacccggaacttacccgggttactaacgtttaacttaaccggggttacgtaacggtaacgtacggttacgttaccggttacggtacgtttacgtttacgg

SEQ ID NO: 349828 - DNA, 764 bp, Homo sapiens
  misc_feature: GZ8MTXP02GD0EH.45.37.D04.1.454.CMB.2.raw
  modified_base (646)..(646): a, c, t, g, unknown or other
  misc_feature (646)..(646): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggagatcctcttcttggtggcagcagccacaagacgcccactcccaggtgcagctggtgcagtcgtggggctggaggtgaaggaacgccggtggggccttacgaggtgaacggtcctccgtagacgtaaggtcttcgtacggacctaccgtaaccctttccggaaccgggtacctaaccttaacttcccgttaccccgaacgggttcggggttaccgaccggaacccgaccggggttcccccaggggtaaaccggtaacggggttcgtttagggaacgggttgggtaacggttggggtaaacgttacgggtaactaaccccgttaaaacccgttaaaccgtaaaggttcggggtacgacctaaaactaaaaccgtatcgggactaaaccgtaagggttaacggttacgaacgggggtacgtaacgggtaccaacgtacgtacgaacggtaaacggacccgtacgaccaatcgaagacctaaccgacggtaccaagcgtaacggcttacgagacganacgtacacgacgtagtcgaacgaacgtaccggtacgtacttaatttaacgtcgtcggtacggtacgtaaggttacgttacgggttacggtcgtttccggtttacggtttacgttacgg

SEQ ID NO: 349829 - DNA, 690 bp, Homo sapiens
  misc_feature: GZ8MTXP02I0YLL.45.37.D04.1.454.CMB.2.raw
  modified_base (257)..(257): a, c, t, g, unknown or other
  misc_feature (257)..(257): n is a, c, g, or t
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (332)..(332): a, c, t, g, unknown or other
  misc_feature (332)..(332): n is a, c, g, or t
tcagacgcgatcgacacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtggaggaaggccgtggggcctcgagtgaaggtctcctgcgaggcttcgnggctacacttcaccggcgacactcncctatcgggtncgtacgcgcccgtagacgtaaggtcttagacgtggtagngggtactggactaccgaaacccctaacgaagtggtacggcaaacgaactctgactacgaagtacgttcgaagggctacggggactaccgaagtccggaacgaacggtacaccggtaacactaccgagaccgtaaaccgaggtacctaccgtaagtaccggggacgtaacgtacgacggtacgaaacggttaacgtacggtaaccttaacgaccggtaaacggaacccggtaaaccgtaaaccggttaacctttaaacgttttaacccggttacgttacggtaacgggtaacgttaagggttaacggtttccggggtttaccggtttcgggtttaccgtttttccgggttttaacccgg

SEQ ID NO: 349830 - DNA, 611 bp, Homo sapiens
  misc_feature: GZ8MTXP02IOQWA.45.37.D04.1.454.CMB.2.raw
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (397)..(397): a, c, t, g, unknown or other
  misc_feature (397)..(397): n is a, c, g, or t
  modified_base (509)..(509): a, c, t, g, unknown or other
  misc_feature (509)..(509): n is a, c, g, or t
  modified_base (525)..(525): a, c, t, g, unknown or other
  misc_feature (525)..(525): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggagccgtggggcctnagtgaaggtctcctgacaggcttcnggctacnccttacgaccggcgactatcctaccgagtgggtcgcgtacgaccggtcccccgtggaccggaagggtctacggtaggtaggagtggggatggactaccgaaaccccctaagacgttggacgacaaacgaaactgtacncgtaaacgagtaaacgtttcgaaagggtccgaagggtaccaacgtagtacgaaccggtacgggacctaccgtacgacacgacgaccactacgaccctagtagtcggagtacngacgtacacgcagacncgtacgtacgacgacgtccgtacttacgtttacgtacgtggtagaacgtcgtaacgttcggttacgtacggtctttcggtttaccg

SEQ ID NO: 349831 - DNA, 683 bp, Homo sapiens
  misc_feature: GZ8MTXP02GI458.45.37.D04.1.454.CMB.2.raw
  modified_base (143)..(143): a, c, t, g, unknown or other
  misc_feature (143)..(143): n is a, c, g, or t
  modified_base (540)..(540): a, c, t, g, unknown or other
  misc_feature (540)..(540): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctnttcttggtggcagcagccacaagagcccactcccaggtgcagctggtgcagtctggggctgaggtgaggaagccgtgggctcagtgagtctcctgcaggcttctggctacaccttcgaccggtcgactagtctccacgtggtgccgacgacggtccccgtggaccgtaagggtcgttacggaggtgggtagtggggactagggactccgaaaccccctaaacaagtcggtacggacaaaccgtaaacgtagtcgaaccgaaacgtaagtaaacgggttttcgaacgggggtaccgaacggggttacccgaacccgttaaagtaccggaaacccggaacgggggaccctaccggtaaccctaacgtacgaacgacgaacgtacgaacctacgttacgnggacacgtaggacggacttaaggactacggaactacgtcgtaacggaacgaccgtaccgtaccgttaaactttaacgttaacggtcgtacgaagggtaacgtaggtttacggttacccggtggttcgttacggtttttcccgg

SEQ ID NO: 349832 - DNA, 617 bp, Homo sapiens
  misc_feature: GZ8MTXP02HWUGY.45.37.D04.1.454.CMB.2.raw
  modified_base (226)..(226): a, c, t, g, unknown or other
  misc_feature (226)..(226): n is a, c, g, or t
  modified_base (293)..(293): a, c, t, g, unknown or other
  misc_feature (293)..(293): n is a, c, g, or t
  modified_base (377)..(377): a, c, t, g, unknown or other
  misc_feature (377)..(377): n is a, c, g, or t
  modified_base (454)..(454): a, c, t, g, unknown or other
  misc_feature (454)..(454): n is a, c, g, or t
tcagacgcgatcgacacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctnagtgaaggtctctgcaaggcttctggctacaccttcacccggcaactatctccactggggtccgacncggtcccctggaacgaacgggcttaggaggtggagtggatgggataccaacctaagacgttggtacggactaacgaaaacttangtacactaggtagtttcgaagggtcagggtacaaccagtcgaacagggaactacgtacatacagacacaagtcctanatacgggatcgagagacgaagacgtagactagtactacggaaaccgacgtaaccgtaccgttaatttaaacgttaccgtaggtttaccggacggtaaaggtaagttttaccggggtttaccgggtaggttacccgtttagggtttttaccccttttaacgggg

SEQ ID NO: 349833 - DNA, 690 bp, Homo sapiens
  misc_feature: GZ8MTXP02GUD9D.45.37.D04.1.454.CMB.2.raw
  modified_base (459)..(459): a, c, t, g, unknown or other
  misc_feature (459)..(459): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctggaggtgaggaagccgtggggcctcgagtgaggtctccgtgcaaggtcttcgtggcctacacccgttcgaccggacgactactcctccgacgtgggtgcgaccgtaccggccccgtaggaccgaagggtcgttaggaggtagggagtcgggagtggactaccgaaacccccgtaaagacgtgggtacgacaaacgtaaactagtcgacaacgtaagtaaacgtttacggaggggccgtaaagggtaccaaccgtanacggaaccgaacgggacctaccggtcccaagtaccaaggccaaacgtaacggaccccttaaggagtccggaagtccgaacgagaccaagacctggaactacgtccgtaacgaccggtaaaccaccggttaaccttaattttaacgttacggtcggttacgaaccggtttaaggggttacgtttaccggggttttaccgggtcggtttcccgttttacgggtttttacccgg

SEQ ID NO: 349834 - DNA, 531 bp, Homo sapiens
  misc_feature: GZ8MTXP01EKG8C.51.30.C08.1.454.CMB.2.raw
  modified_base (238)..(238): a, c, t, g, unknown or other
  misc_feature (238)..(238): n is a, c, g, or t
  modified_base (324)..(324): a, c, t, g, unknown or other
  misc_feature (324)..(324): n is a, c, g, or t
tcagcgatcgtatacacgaccggtgctcgatttagtctgacgtcaaagggaaaggggtgggctcaggaggcagagctctgggaatctcaccatggcctggacccctctcctgctcccctcctcactttctgcacagtctctgaggcctcctatgagctgacacagtcaccctcgctgtcagtgtccccaggacaaacggccaggatcacctgctctggagatgcattgaccaaaaagntatgcttattggtaccatcagaagtcaggccaggcccctgtactgtcatctatgagacacaaacgcctcgggatcctagagattcnctcggctcgagtttaggacaagtcgccacctgacaatcgagggtggggcccgagggtggggatggagggtgattacgtacttgttactacaacagactattactactactctagtagggtgttcggacggagggactaagctcgaccgtcgtaggttcacgccgaaggcttcgccccttcggcactctcgtcccacctccgttctcg

SEQ ID NO: 349835 - DNA, 513 bp, Homo sapiens
  misc_feature: GZ8MTXP01CRHTE.51.30.C08.1.454.CMB.2.raw
  modified_base (236)..(236): a, c, t, g, unknown or other
  misc_feature (236)..(236): n is a, c, g, or t
  modified_base (304)..(304): a, c, t, g, unknown or other
  misc_feature (304)..(304): n is a, c, g, or t
  modified_base (317)..(317): a, c, t, g, unknown or other
  misc_feature (317)..(317): n is a, c, g, or t
  modified_base (415)..(415): a, c, t, g, unknown or other
  misc_feature (415)..(415): n is a, c, g, or t
  modified_base (444)..(444): a, c, t, g, unknown or other
  misc_feature (444)..(444): n is a, c, g, or t
tcagcgatcgtatacacgaccggtgctcgatttagtctgacgtcaaagggaaaggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcactgctctggagatgcattgacaaaagntatgcttatgtacatcagatcagcaggccctgtactgtcatctatgagacaccaaacgccctcgggancctagagacttcnctcggctcgagtttaggacaagtcgccacctgacatcaggtgggccaggtggggatgaggtgattactactgtactcaacagactattactactactnacgtaggtgtcgaggacgggactaaggcngaccgtccgtagttcgacgccgaaagcttcgccccttacggtcactctcgtcccgcctccgttcgtccg

SEQ ID NO: 349836 - DNA, 532 bp, Homo sapiens
  misc_feature: GZ8MTXP01BBOBY.51.30.C08.1.454.CMB.2.raw
  modified_base (240)..(240): a, c, t, g, unknown or other
  misc_feature (240)..(240): n is a, c, g, or t
  modified_base (508)..(508): a, c, t, g, unknown or other
  misc_feature (508)..(508): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaagntatgcttattggtaccatcagaagtcaggccaggcccctgtactggtcatctatgaggacaaccaaacgcccctcgggactccctacgagattctctcggctcgagtttggacaagtcggccacctgacatcgagtggggccagggtggggatggagggtgattactactgtactacaacagacattactactactcagtaggtgttcggcggaggaccaagctcgccgtctaggttcacgcccgtaaggcttcgccccttcggtccnctctcgtccccacctccttcgtcg

SEQ ID NO: 349837 - DNA, 534 bp, Homo sapiens
  misc_feature: GZ8MTXP01BLQ90.51.30.C08.1.454.CMB.2.raw
  modified_base (239)..(239): a, c, t, g, unknown or other
  misc_feature (239)..(239): n is a, c, g, or t
  modified_base (330)..(330): a, c, t, g, unknown or other
  misc_feature (330)..(330): n is a, c, g, or t
tcagcgatcgtatacacgaccggtgctcgatttagtctgacgtcaaagggaaaggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaagntatgcttatggtaccatcagaagtcaggccaggcccctgtactggtcatctatgaggacaccaaacgccctccgggatccctagagattcnctggctcagtttaggcaagtcggccacctgacaatcgaggtggggcccaggtggggatggagggtgattacgtactgttactcaacagacattaactactactcagtagggtgttcggcggagggaccaaggctcgaccgtctaaggttcacgcccgaaaggcttcgccccttcggtccactcgtcgtcccgcctccttctccg

SEQ ID NO: 349838 - DNA, 575 bp, Homo sapiens
  misc_feature: GZ8MTXP01D8NA5.51.30.C08.1.454.CMB.2.raw
  modified_base (240)..(240): a, c, t, g, unknown or other
  misc_feature (240)..(240): n is a, c, g, or t
  modified_base (408)..(408): a, c, t, g, unknown or other
  misc_feature (408)..(408): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaagntatgcttattggtaccatcagagtcaggccaggcccctgtactggtcatctatgagaacaccaaacgccctcgggactcctagagtattctctcggctacgtagttaggacaagtcgccaccctgaacatcgagggtcggggacccgaggggtggggatgggagggtntactttactactgttacacaacagactattaactactactactagtagggtgttcggacggagggacctaagcgtcgcccgtcgtaggttcgacgcccgaaggtccttccgccccgttcggtcctaccttccgttcccggttccccgttcccttccgttccgttccg

SEQ ID NO: 349839 - DNA, 601 bp, Homo sapiens
  misc_feature: GZ8MTXP01CH2V1.51.30.C08.1.454.CMB.2.raw
  modified_base (240)..(240): a, c, t, g, unknown or other
  misc_feature (240)..(240): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaagntatgcttattggtaccatcagaagtcaggccaggcccctgtactggtcatctatgaggacaccaaacgccctcgggactccgagagacttctctcggcctcgaggtttacggactaaggtcggcccacctgactaagtcgagggtcggggcccgtaggggtggggatggaggggtgtaagttacgtacgttgttactacaacaagactaactttaacgtacttaactcaagttagggtcgttcgggacggtacgggaccgtaaggcgtacgaccgtccgtaggttccgacgttaccgaacggtcttccgccccgttcgggtccaccgttccttccgttccccttacccgtccttcgtcccg

SEQ ID NO: 349840 - DNA, 577 bp, Homo sapiens
  misc_feature: GZ8MTXP01E4NBY.51.30.C08.1.454.CMB.2.raw
  modified_base (219)..(219): a, c, t, g, unknown or other
  misc_feature (219)..(219): n is a, c, g, or t
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
  modified_base (288)..(288): a, c, t, g, unknown or other
  misc_feature (288)..(288): n is a, c, g, or t
  modified_base (303)..(303): a, c, t, g, unknown or other
  misc_feature (303)..(303): n is a, c, g, or t
  modified_base (353)..(353): a, c, t, g, unknown or other
  misc_feature (353)..(353): n is a, c, g, or t
tcagcgatcgtatacacgaccggtgctcgatttagtctgacgtcaaagggaaagggggtgggctcaggaggcagagctctgggaatctcaccatggcctggacccctctcctgcctccccctcctcactttctgcacagtctctgaggcctcctatgagctgacacagtcaccctcgctgtcagtcgtccccaggacaaacggccaggatcacctgctntgganatgcattgacaaaagntatgcttatggacatcagatcaggccacggccctgtactgtcatctangagacacaaacgccncggactccagatatctctcgctcgagttaggacaagtcgccacctgacancgagggtcgggcccgaggggtggggagtgggagggtagtagttacgtacgttagttactacaacagtactattacgtactactacgagtagggtgtcggacggaggaccgaagcgtcgacccgtcgtacggttacgacgttaccgaacggtcacccgttcccccgttacggtcccaccgttcccgttccgttcccccttaccccttcccgttccgttaacccgg

SEQ ID NO: 349841 - DNA, 617 bp, Homo sapiens
  misc_feature: GZ8MTXP01C8XIO.51.30.C08.1.454.CMB.2.raw
  modified_base (239)..(239): a, c, t, g, unknown or other
  misc_feature (239)..(239): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcactgctctggagatgcattgaccaaaaagntatgcttattggtaccatcaagaagtcaggccaggcccctgtactgtcatctatgacgacaccaacgcccgtccgggatccctagatattctctcggctaccgtaggttacgggcaaggtcgccaccctgaacagtcgagggtcgggggacccagggtgggggatgggagggtgtagttacgttacgtagttacacaaacagtaactacttacgtaacttacttacgtaaggtaggggtggttcgggacgggtaacgggaccgtaacggtcgtacggtacccgtaaccgtagggttccacggacccgaacgggtccttccggcccccgttcggtcccaccgttccgttccgtccccttaccctcccttccgtaacccg

SEQ ID NO: 349842 - DNA, 665 bp, Homo sapiens
  misc_feature: GZ8MTXP01CZ7GV.51.30.C08.1.454.CMB.2.raw
  modified_base (235)..(235): a, c, t, g, unknown or other
  misc_feature (235)..(235): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtcccaggacaacggccaggatcactgctctggagatgcatgaccaaaagntatgtcttatggtaccatcagagtcaggccagccctgtactgtcatctatgagacaacaaacgcccgtacgggactcccgtagagtacttctacgtcggctacgtaggtttacgggactaacggtcggcccaccctagaactactcgagggtcggggacccgtaggggtggggatgggaggtagtagttaacgtacgttgttaactacaaacgtgtaaacctaatttaaccgtaacttaacgttctaaagggttaggggttacgtttccggggacggaaacggggtaaccaaaggtcctacgggacccgttaaccgtaacgggttcaccggacccgaaacgggtcccgttcccggttcccccgttacgggtccctaacccggttcccttcccggttacccccttaacccctttcccgttccgtttcccgg

SEQ ID NO: 349843 - DNA, 534 bp, Homo sapiens
  misc_feature: GZ8MTXP01AS1QG.51.30.C08.1.454.CMB.2.raw
  modified_base (239)..(239): a, c, t, g, unknown or other
  misc_feature (239)..(239): n is a, c, g, or t
  modified_base (423)..(423): a, c, t, g, unknown or other
  misc_feature (423)..(423): n is a, c, g, or t
  modified_base (439)..(439): a, c, t, g, unknown or other
  misc_feature (439)..(439): n is a, c, g, or t
  modified_base (507)..(507): a, c, t, g, unknown or other
  misc_feature (507)..(507): n is a, c, g, or t
  modified_base (520)..(520): a, c, t, g, unknown or other
  misc_feature (520)..(520): n is a, c, g, or t
tcagcgatcgtatacacgaccggtgctcgatttagtctgacgtcaaagggaaaggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaagntatgcttattggtaccatcagaagtcaggccaggcccctgtactggtcatctatgaggacacaaacgccctcgggatccctagagattctctcggctcgagtttaggacaagtcgccaccctgacaatcgaggtggggcccgagggtggggagtggagggtgattactactgtactcaacgaanactattactactactnagtaggtgtcggcggacggacagcgtcgccgtcgtaggttcacgccgacggcttccgccccttcgtcnctcctcgtccccnccctccgttcgtcg

SEQ ID NO: 349844 - DNA, 614 bp, Homo sapiens
  misc_feature: GZ8MTXP01A8B4J.51.30.C08.1.454.CMB.2.raw
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaaccaaaaagatatgtcttattggtaaccatcaagaagtcacggccacggcccctgtactggtcatctatggacgaccaaccgaaaccgccccgtccgggactcccgtacgagtacttctcgtcggccttacgtaggtttaggactaaggtcggcccaccctgaccaagtcgaggtcggggacccgaggggtcgggggagtgggagggtgtagttacgtacgttagttactacaacagtactacttactactacgtctacggtagggttcggttcggacgggaacgggtacaaggtcgtacgtaccgtccgtaaggttcgacgaccgtaacggccttccggccccgttggtaacctcgtctccgtcccaccctcttcgtaaccg

SEQ ID NO: 349845 - DNA, 618 bp, Homo sapiens
  misc_feature: GZ8MTXP01DVUHZ.51.30.C08.1.454.CMB.2.raw
  modified_base (240)..(240): a, c, t, g, unknown or other
  misc_feature (240)..(240): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctctatgagctgacacagtcaccctgctgtcagtcgtccccaggacaacggccaggatcacctgctctggagatgctattgaaccaaaaagntatgtcttattggtacatacaagaagtcgacggcaacggccctgtactggtcatctagtgacggaaccaaccgaaaccgtaccctcccgggactacccgtacgactacttctcgtacggcctacgaggtttacggacaacggtcgcccacctgaacatcgagggtcggggaccgaggggtggggagtggagggtgtaacgttacttacttagtttacactaaacgagtaactacttaacgttaacttacgtacgtagttaggggtgttcgggacgggtaacgacgtacgtcgtcggaccgtcgtaacggttcgacggccgaacggtccgttaccgcccgttcggtctacctcttaccgtcccttaccctcttccgtcg

SEQ ID NO: 349846 - DNA, 560 bp, Homo sapiens
  misc_feature: GZ8MTXP01ASG1F.51.30.C08.1.454.CMB.2.raw
  modified_base (239)..(239): a, c, t, g, unknown or other
  misc_feature (239)..(239): n is a, c, g, or t
  modified_base (325)..(325): a, c, t, g, unknown or other
  misc_feature (325)..(325): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaagntatgcttatggtaccatcagagtcaggccaggccctgtactgtcatctatgagacaccaacgccctcgggactcctagagtattcnctcggctcgagtttaggactaagtcggcccaccgtgacaatcgaggtcggggcccgaggggtcggggatgggagggtgtattacgtacgtgtactacaacagactacttactactacgtacagttagggtgttcggacggagggacctaaggctcggaccgtcgtacggcgacgcccgaaggtccttcggccccttcggtcctacgtccttcgtccccaccctccgttcgtccgg

SEQ ID NO: 349847 - DNA, 687 bp, Homo sapiens
  misc_feature: GZ8MTXP01DZT08.51.30.C08.1.454.CMB.2.raw
  modified_base (221)..(221): a, c, t, g, unknown or other
  misc_feature (221)..(221): n is a, c, g, or t
  modified_base (242)..(242): a, c, t, g, unknown or other
  misc_feature (242)..(242): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtcgtccccaggacaacggccaggatcactgctctgganatgcattagaaccaaaaagtntatgtacttagttacggtaaccatacaagaacgtcgaacggccgacggtcccctagtaccgtggtacattctaagtggaacggaaccaaaccccgaaaaccggtccccgtaccgggaactacccgtaacgacgtacttcctcgtccggcctacgtaggttacggactaacggtcgcccaccgtagaacacgtcgagggtcggggaccgtaggggtcggggatgggaggtataacgtttactacgttagtacacaaacagtaactacttaactactacgtagtacggtagggtcgtcgggacgggaaacgggaccgtaagtccgtacggaacccggttaacgtaggggaccaaccggttacccgaacgggtcccgttacccggcccccgttacggtccctaccttccgtttaccccggtccccttaccgttccccttcgttaaccg

SEQ ID NO: 349848 - DNA, 634 bp, Homo sapiens
  misc_feature: GZ8MTXP01DQHTC.51.30.C08.1.454.CMB.2.raw
  modified_base (242)..(242): a, c, t, g, unknown or other
  misc_feature (242)..(242): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtcgtccccaggacaaacggccaggatcacctgctctggagatgctattgaccaaaaagntatgcttatggacatcagaagtcagccacggcccctgtactggtcatctatgacgaccaaccaaacgcccctcgggactccctacgagtacttctacgtcggcctaccgtaggtttacgggactaaggtcggcccaccctgaacctaagtcgaggtcgggggccctagggggtggggtatgggagggtgtaactttactacgtagttaccgtacaaacgacgtaactacttaacgttaactacgtaccgtaagttaggggtcggttccgggaggaacgggacctagcgtacggaaccgttccgtaaggttaccacgttacccgaacgtccgttacgttcccccgttacggtcctactccgttacctccccttacccttccgttcgttaaccg

SEQ ID NO: 349849 - DNA, 726 bp, Homo sapiens
  misc_feature: GZ8MTXP01A86R5.51.30.C08.1.454.CMB.2.raw
  modified_base (245)..(245): a, c, t, g, unknown or other
  misc_feature (245)..(245): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtccaccctcgctgtcagtcgtccccaggacaaacggccaggatcacctgctctggagatgcattagaaccaaaaagtntatgtacttattcggtacatacaagaacgtcgaggcccgacggcccctgtacgtggtacatcgtatggaacggaccaacccgaaaccgaccccgtacccgggtaactacccccgtaacggtaacgtacttccgtccgtcggtaccttaccgtaaggttttaccggggactaaacgggtcggaacccctacccgtagaaccaacgttcgaacggggtcgggggccccgaagggggtgggggaagtggggagggttagtaagtttaaccgttacgttacggttaactaccgaaacacgtaacctatttaaccgtaacttacgtacgtaaggttcggggttacgttcggggacgggaacggtaccgaaggtcctacggtacccggtccgttaacggttcgaacccggttaccgaacgggtccttcccgccccgttccgggtcacccttccgttacccgttccccaccttccccttccgtaaccg

SEQ ID NO: 349850 - DNA, 685 bp, Homo sapiens
  misc_feature: GZ8MTXP01C7PMD.51.30.C08.1.454.CMB.2.raw
  modified_base (238)..(238): a, c, t, g, unknown or other
  misc_feature (238)..(238): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaacggccaggatcactgctctggagatgcattgaaccaaaagntatgtacttattggtaccatcagaagtcaggccacgcccctgtactggtcatctatgaggaccaacccgaaaccgaccccgtaccgggactccccgtagtacgacttctcgtcggtcctaccgtagggttttaacgggaccgtaaggttccgggccctacccgtagaaacctaaacgtccgaaggggttcgggggacccgtagggggtgggggagtgggagggtgtaattacgttacgttgttaacgtcgaaactagactaacttacgtactacgtagtacggttaggggtcgttacgggcgggaacggggacctaaaggtccgtacgggtaaccccggttaaccgtaagggttccaacggacccgtaaacgggccttacccggttcccccgttacggtccctacctccgtttccgtcccccttacccttcccgttcgttaacccgg

SEQ ID NO: 349851 - DNA, 840 bp, Homo sapiens
  misc_feature: GZ8MTXP01CD80I.51.30.C08.1.454.CMB.2.raw
  modified_base (243)..(243): a, c, t, g, unknown or other
  misc_feature (243)..(243): n is a, c, g, or t
tcagcgatcgtatacacgaccggtgctcgatttagtctgacgtcaaagggaaagggggtgggctcaggaggcagagctctgggaatctcaccatggcctggacccctctcctgcctccccctcctcactttctgcacagtctctgaggcctcctatgagctgacacagtcaccctcgctgtcagtcgtcccaggacaaacggccaggatcactgctctggagatgactattgaaccaaaaagntatgtacttattcggtaccatcaagaagtcacggccacggccctgtactggtcatctagtagacggaacaaccgaaaccgccccgtaccgggactacccgtaagagtacttccgtcgtcggccttacgtaaggtttacggaacctaagggttccgcccgtaacccgtaggaaacctaaacgtccggaacgggggttccgggggaccccgtaaggggggtacggggggtaagtacggggtaacggggttagttaaacgtttaaccgttaacgtttacggtttaaacctaacgaaactaaacggaacttaaccgtttaaaccgtaaccgtttaaacttaccggtaaaggtttaacgggggttacgggttaccggggaaccggggtaaacggggtaacccgaaacgggtccggttaaccgggtaacccgggttaacccggtttaacgggttacccggaaacccggttaaccccggaaaccggtccccggttacccccgggttccccccggtttcccggggttaaccctaaaccccgtttcccgtttcccccgggtttaccccccgttcccctttaaccccggttccgtttaaccccgggg

SEQ ID NO: 349852 - DNA, 796 bp, Homo sapiens
  misc_feature: GZ8MTXP01BXFV2.51.30.C08.1.454.CMB.2.raw
  modified_base (247)..(247): a, c, t, g, unknown or other
  misc_feature (247)..(247): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtccaccctcgctgtcagtcgtccccaaggacaaacggccaggatcacctgctctggagatgctattgaacctaaaaagtntatgtacttagttacggactatcaagaagtcacggccacggccctgtactggtacatctagtgaacgaaccaacccgaaaccgtaccccgtacccggggaacttaccccgtaacggtagtacttccgtcgttaccgggccttaccggttagggtttaaccgggacgtaacgggtcccggtccctaacccgtagaaccgtaaagtccggtaacgggggtcggggacccgtaagggggtgggggtagtaggggtagggtaggtaactttaaccgtacgttacggttaaccacgaaaaccgtaaggtaaccttaaacgtttaacgttaaactttaacggttacgttaacggggttaagggtttccggggttaccggggtacgggaaccggggtaaacctaaccgggtaccgttacggtaaacccggttccggttaacggaccgaaccgttacccggaaacgggtcccttaccccggttcccccggttccgtaaccgtcccgttcccggtttacccgttccccgttaccccttcccgttcccgtttaacccgg

SEQ ID NO: 349853 - DNA, 682 bp, Homo sapiens
  misc_feature: GZ8MTXP01EF0QS.51.30.C08.1.454.CMB.2.raw
  modified_base (244)..(244): a, c, t, g, unknown or other
  misc_feature (244)..(244): n is a, c, g, or t
  modified_base (500)..(500): a, c, t, g, unknown or other
  misc_feature (500)..(500): n is a, c, g, or t
tcagcgatcgtatacacgaccggtgctcgatttagtctgacgtcaaagggaaaggggggtgggctcaggaggcagagctctgggaatctcaccatggcctggaccctctcctgctccccctcctcactttctgcacagtctctgaggcctcctatgagctgacacagtcaccctgctgtcagtcgtcccaggacaaacggccaggatcacctgctctggagatgactagttgaaaccaaaaagntataggtactttaagttcggtaaccatacgaagaagtcgacggaccaacgggtccccttaggtaaccgtggtaccaattactagtacggaacgaaccaaacccgaaaaccgtccccgtaccgggactacccgtacgtagtacttcgtacgtcggccttacgtaggtttacggacacgtcgccacctagacatcgacgggcggggaccgtaggggtggggatgggagggtatatttaacgtacttagttacacaaanactaacttaacttaacgtaactacgtacgtaggttacgggtcggtacgggacggtaacggacgtaacgtcgtacggtaccggtaacgtacggttaccgacggaccgtacggtcccgttcccggttcccgttacggtaaccttccttccgttaccccgttccccttacctttccgttcgtccg

SEQ ID NO: 349854 - DNA, 611 bp, Homo sapiens
  misc_feature: GZ8MTXP01DHXOX.51.30.C08.1.454.CMB.2.raw
  modified_base (240)..(240): a, c, t, g, unknown or other
  misc_feature (240)..(240): n is a, c, g, or t
  modified_base (451)..(451): a, c, t, g, unknown or other
  misc_feature (451)..(451): n is a, c, g, or t
tcagcgatcgtatacacgaccggtgctcgatttagtctgacgtcaaagggaaagggggtgggctcaggaggcagagctctgggaatctcaccatggcctggacccctctcctgcctccccctcctcactttctgcacagtctctgaggcctcctatgagctgacacagtcaccctcgctgtcagtgtccccaggacaaacggccaggatcacctgctctggagatgcatgaccaaaaagntatgcttatggtacatcagaagtcaggccaggcccctgtactggtacatctatagacggaaccaaccgaaacgaccccgtccgggaactcccctagagtacttcgtactcggcctcgtagtttacggggactaaggtcggcccaacctagaaacatcgaaggtcggggcccgaggggtggggattggagggtagaattacgtatgttaacncgaaactagaactattaacgtactaacgtcaagttagggtcgttaggacggtaagggacctaagccgtcgaccgtcgtaacggttcacgcccgaaagggccttaccgggccccttcgggtcctacctccgttcgttccccaccccttccgttcgtaaccg

SEQ ID NO: 349855 - DNA, 818 bp, Homo sapiens
  misc_feature: GZ8MTXP01B49K3.51.30.C08.1.454.CMB.2.raw
  modified_base (797)..(797): a, c, t, g, unknown or other
  misc_feature (797)..(797): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtcgtccccaggacaaacggccaggatcacctgctcgtggagatgactattagaacctaaaaagtatagtcgttacttagttcggtaaccatacgaaggaacgtcgaacggtcccgacggtcccccttaggttaccgtggttaccattaccgtaagtacggaaaccgggaaccaaaccccgaaacccggtaccccggtacccgggtaacttaccccggtaacggtacgttacttaccgttcgtaccgggtccttaccggttaagggttttacggggaacccgtacgggttaccgggaaccccaacccgttacgaaccgtacggtaccggtacgggggttacgggggacccgtagggggttagggggacttacggggaggggttacttaagtttaaccgttacgtttacgtttaaccgaaccaaacgtacgtaacttacgtttaacctaacgtttacgttaccgagggtttacggggtcggttaccggggacgggtaaacggccgtaaagtccggtaccggacccggttccgttaagcccggtaccgacccgtaacggtccgttcccccggttccccgttacggtcccttacccgtcgtttcccccgggttccccnccccgttcgttcccgttcccg

SEQ ID NO: 349856 - DNA, 527 bp, Homo sapiens
  misc_feature: GZ8MTXP02JWPSK.51.30.C08.1.454.CMB.2.raw
  modified_base (238)..(238): a, c, t, g, unknown or other
  misc_feature (238)..(238): n is a, c, g, or t
  modified_base (329)..(329): a, c, t, g, unknown or other
  misc_feature (329)..(329): n is a, c, g, or t
  modified_base (357)..(357): a, c, t, g, unknown or other
  misc_feature (357)..(357): n is a, c, g, or t
  modified_base (499)..(499): a, c, t, g, unknown or other
  misc_feature (499)..(499): n is a, c, g, or t
tcagcgatcgtatacacgaccggtgctcgatttagtctgacgtcaaagggaaaggggtgggctcaggaggcagagctctgggaatctcaccatggcctggacccctctcctgctcccctcctcactttctgcacagtctctgaggcctcctatgagctgacacagtcaccctcgctgtcagtgtccccaggacaaacggccaggatcacctgctctggagatgcattgaccaaaaagntatgcttattggtaccatcagaagtcaggccaggcccctgtactggttatctatgaggacaccaaacgcctccgggatccctagagattcnctggcctccagtttagggacagtggccncctgacaatcagtggggcccagggtgggggatggagggtgattactagtgttactcaacagacattactactactcatagggtgttcgcgggaggaccaagctgaccgtctacggtcagcccaaggctcgccccctcggtcncgtctcgttcccgccctcctctcgtacg

SEQ ID NO: 349857 - DNA, 700 bp, Homo sapiens
  misc_feature: GZ8MTXP02JC05E.51.30.C08.1.454.CMB.2.raw
  modified_base (239)..(239): a, c, t, g, unknown or other
  misc_feature (239)..(239): n is a, c, g, or t
tcagcgatcgtatacacgaccggtgctcgatttagtctgacgtcaaagggaaaggggtgggctcaggaggcagagctctgggaatctcaccatggcctggacccctctcctgctcccctcctcactttctgcacagtctctgaggcctcctatgagctgacacagtcaccctcgctgtcagtcgtcccaggacaaacggccaggatcacctgctctggagatgcattgaccaaaaagtntatgtcttagttcggtacatacgaagaacgtcgacggaccgacggtcccctgtacgtggtctatctagtcggaacgaaccaaccgaaaccgtaccccgtaccgggacctacccgtaacgagtacttctcgtccggtcctaccgtaaggttacgggactacggtcgccctaccgtagaactagtcgagggtcggggaccgtagggggtgggggtagtaggggtagggtgtaacgttacgtacgttacgttaacacgaaacgtacgtaaacttacttaacctaacttacgtacgtaagggttacggggttcggtaccggggacgggaacgggtaaccgaacggtcgtacggtacccgttacgtacggtaccgaccggacccgtaacggtcccgtacccggtcccccgttcggtaacccgtaccgttcccgttcccgttacccctacccgttcccgtcgtaccg

SEQ ID NO: 349858 - DNA, 556 bp, Homo sapiens
  misc_feature: GZ8MTXP02G0F5X.51.30.C08.1.454.CMB.2.raw
  modified_base (332)..(332): a, c, t, g, unknown or other
  misc_feature (332)..(332): n is a, c, g, or t
tcagcgatcgtatacacgaccggtgctcgatttagtctgacgtcaaagggaaaggggtgggctcaggaggcagagctctgggaatctcaccatggcctggacccctctcctgcctcccctcctcactttctgcacagtctctgaggcctcctatgagctgacacagtcaccctcgctgtcagtcgtccccaggacaaacggccaggatcacctgctctggagatgcattgaccaaaagatatgcttattggtaccatcagaagtcaggccacggcccctgtactggtcatctatgaggacaaccaaacgccctacgggatcctagagattcntggctcagttaggacagtcgccacctgacaatcgaggtcggggacccaggggtggggagtgggagggtgtatttacgtacgttacggttactacaaacgagtaaactatttaacctactactacagtagggtgttcggacgggaaggaccgaagtcgtacgaccgtccgtaggtacgacgaccaacggcctcgccccgtcgctactcgtctcccacctctctcg

SEQ ID NO: 349859 - DNA, 545 bp, Homo sapiens
  misc_feature: GZ8MTXP02HPGFW.51.30.C08.1.454.CMB.2.raw
  modified_base (240)..(240): a, c, t, g, unknown or other
  misc_feature (240)..(240): n is a, c, g, or t
  modified_base (332)..(332): a, c, t, g, unknown or other
  misc_feature (332)..(332): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaagntatgcttattggtaccatcagaagtcaggccaggcccctgtactggtcatctatgaggacaccaaacgccctcgggactccctagagattcnctggctcctagtttacggacaggttcggccacccgtgaacaatcgaggtcggggcccgaggggtgggggatgggaggggtgagtttactacgttagttactacaacagactattactactactcagtaggtgtcggacggaggacaagcgtgaccgtcgtaggtcacgccaagctacgcccctggccactccgtacgtcccacctcctctccg

SEQ ID NO: 349860 - DNA, 581 bp, Homo sapiens
  misc_feature: GZ8MTXP02GJCJJ.51.30.C08.1.454.CMB.2.raw
  modified_base (239)..(239): a, c, t, g, unknown or other
  misc_feature (239)..(239): n is a, c, g, or t
  modified_base (418)..(418): a, c, t, g, unknown or other
  misc_feature (418)..(418): n is a, c, g, or t
tcagcgatcgtatacacgaccggtgctcgatttagtctgacgtcaaagggaaaggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaagntatgcttattggtaccatcagaagtcaggccaggcccctgtactggtcatctatgaggacaccaaacgccctcgggactccctagagattctctcggctccgtaggtttacgggacaggttcggccctaccctgactaatcgaggtcgggggcccgaggggtgggggatgggaggggtntagttacgtactgttacacaacgagactattactacttactctagtagggtgttcgggcggtaggacaagcgtcgacccgtcgtacggtcacggacccgaacggcctccgcccccgttacggtcctaccgttccgtccgttccccacccttccctcgttaccg

SEQ ID NO: 349861 - DNA, 559 bp, Homo sapiens
  misc_feature: GZ8MTXP02HECBG.51.30.C08.1.454.CMB.2.raw
  modified_base (239)..(239): a, c, t, g, unknown or other
  misc_feature (239)..(239): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaagntatgcttattggaccatcagaagtcaggccaggcccctgtactggtcatctatgagacaccaaacgacccgtaccgggactccctacgagtacttctctcggctccgtagtttagggactaggtcgcccaccctgaccaatcgaggtcgggggcccaggggtcgggggatggagggtgagttactacgtgttactcaaacagaactattactactactcgagtagggtgttcggaggagggacaagcgtgaccgtcgtaggtcacgtccgaacggcgtaccgccccgtcggcactcgtcgttccccgccctcctctaccg

SEQ ID NO: 349862 - DNA, 583 bp, Homo sapiens
  misc_feature: GZ8MTXP02IEL2Q.51.30.C08.1.454.CMB.2.raw
  modified_base (243)..(243): a, c, t, g, unknown or other
  misc_feature (243)..(243): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
tcagcgatcgtatacacgaccggtgctcgatttagtctgacgtcaaagggaaagggggtgggctcaggaggcagagctctgggaatctcaccatggcctggacccctctcctgcctcccccctcctcactttctgcacagtctctgaggcctcctatgagctgacacagtccaccctcgctgtcagtcgtccccaggacaaacggccaggatcacctgctctggagatgcattgaccaaaagntatgcttattggtaccatcagaagtcaggccaggcccctgtactggtcatctatgagacaccaaaacgcccctcgggactccctagagtatctctcggcctcctaggtttacggactaggtcggcccacccgtagaaccaattccgaggtcgggggcccaggggtgggggatggaggtgattactatgtacnctaanagactaattactaactactacagtaagggtgttcgggaggacgggtacaagcgtacgacccgttcgtaggtccaacgcccgaaggtcctccgccccctcggtcctaccgtccgttccgttccccgccccttctacccgttccg

SEQ ID NO: 349863 - DNA, 670 bp, Homo sapiens
  misc_feature: GZ8MTXP02JLQ7X.51.30.C08.1.454.CMB.2.raw
  modified_base (242)..(242): a, c, t, g, unknown or other
  misc_feature (242)..(242): n is a, c, g, or t
tcagcgatcgtatacacgaccggtgctcgatttagtctgacgtcaaagggaaagggggtgggctcaggaggcagagctctgggaatctcaccatggcctggacccctctcctgcctcccctcctcactttctgcacagtctctgaggcctcctatgagctgacacagtccaccctcgctgtcagtcgtccccaggacaaacggccaggatcactgctctggagatgcattcgaccaaaagtntatgtcttattggtaccatcaagaagtcaggccacggcccctgtactggtcatctatgagaccacaaacgccctacgggactcctagagtattctctcggtcctccgtagtttagggacaggtcggccaccctgaacctaagtcgacgggtcggggacccgtagggggtcgggggatagggaggggttagtaacgtttaacgtaccgttaggttaacctaacgaaacgtaacgtaaactaactttaaactaacttaacgtaccgttaaggtaaggggttcgttacggggaccgggaacgggaacgtaacggtcgttacgacccgttacgtacggggtacaccggacccgaacggtcctcccggaccccgttcgggtcctaaccgttcccgttccgttacccccaccccgtttcctaccgtttacccgg

SEQ ID NO: 349864 - DNA, 537 bp, Homo sapiens
  misc_feature: GZ8MTXP02FT0KJ.51.30.C08.1.454.CMB.2.raw
  modified_base (239)..(239): a, c, t, g, unknown or other
  misc_feature (239)..(239): n is a, c, g, or t
  modified_base (320)..(320): a, c, t, g, unknown or other
  misc_feature (320)..(320): n is a, c, g, or t
  modified_base (325)..(325): a, c, t, g, unknown or other
  misc_feature (325)..(325): n is a, c, g, or t
  modified_base (525)..(525): a, c, t, g, unknown or other
  misc_feature (525)..(525): n is a, c, g, or t
tcagcgatcgtatacacgaccggtgctcgatttagtctgacgtcaaagggaaaggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaagntatgcttattggtaccatcagaagtcaggccaggcccctgtactggtcatcatgagacacaaacgcctcgggatcctaganattcnctcggctccagtttaggacagtggccacctgacaatcgaggtcggggcccagggtggggatggagggtgtaagttactactgtactcaaacagaaactattaactactactacagtagggtgttcggacggagggacagcgtcgaccgtctagtcacgaccgaacgccgtaccgccccctggtccactcgtccgtccccncctccctctccg

SEQ ID NO: 349865 - DNA, 635 bp, Homo sapiens
  misc_feature: GZ8MTXP02GIS6R.51.30.C08.1.454.CMB.2.raw
  modified_base (240)..(240): a, c, t, g, unknown or other
  misc_feature (240)..(240): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaagntatgcttatggtaccatcagaagtcaggccaggcccctgtactggtcatctatgaggacaaccaaacgcccgtccgggactcccgtacgagtatctctcggctccgtaggtttacggactaggttcggcccacccgtgaacaagtcgaagggtcggggacccgaggggtcgggggatgggaggggtgaagtttacgtacgttgttaactacgaaacgacgaactatttaactacttactactaagttaggggttcgttacgggacgggagggtaaccgaaggtcgtacggaacccgttaccgtacgggtacacggacccgaacgggtcctcccggtcccccgtacggtccgaccttccgttccgtttcccccgccctttcccgtaccgttaccgg

SEQ ID NO: 349866 - DNA, 729 bp, Homo sapiens
  misc_feature: GZ8MTXP02HLCBM.51.30.C08.1.454.CMB.2.raw
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaagatatgcttatggtaccatcagaagtcaggccaggcccctgtactggtcatctagtgacggacaccgaaacgccctcgggactccagatacttctactcggtcctccgtaggtttacgggactaggtcggcccaccgtgactaaactcgagggtcggggacccgagggggtgggggagtgggtacgggggtagtaacgtttaacgttacgttacggtttaaccttacgaaacgaacgtaaacttaattttaaaccttaaacctttacgttaacgtaagggtttaacgggggttacgggtttaccgggggtaccgggggaaacggggtaacccgaaacgggtccgtacgggtaacccggttaccggttacgggtaccgaaccggaccccgtaaacgggtcccgtacccggccccccggttacgggtaaccccgtaccgttcccgtttacccggttccccccgtcccccggttaccccttccgtttaccccggg

SEQ ID NO: 349867 - DNA, 608 bp, Homo sapiens
  misc_feature: GZ8MTXP02JEPYZ.51.30.C08.1.454.CMB.2.raw
  modified_base (238)..(238): a, c, t, g, unknown or other
  misc_feature (238)..(238): n is a, c, g, or t
tcagcgatcgtatacacgaccggtgctcgatttagtctgacgtcaaagggaaaggggtgggctcaggaggcagagctctgggaatctcaccatggcctggacccctctcctgctcccctcctcactttctgcacagtctctgaggcctcctatgagctgacacagtcaccctcgctgtcagtcgtccccaggacaaacggccaggatcacctgctctggagatgcattgaccaaaagntatgcttatggtaccatcagaagtcaggccaggcccctgtactggtcatctatgagaaccaccaaacgcccgtacgggactccgtacgagtattctctcggcctccgtaaggtttacgggactaggttcggccaccttgaacaactcgaggtcggggcccgaaggggtgggggatgggagggtgaattacgtacgtgttactacgaaacagtaactattaactaactactacgtaggttaagggttcgtacgggacggtaagggaccaaggtcgtacggaccgtaccgtaggtaccacggacccaaggcctaccgtccccgtcggtaacctccgttcctacccgttccctaccccttccgtcgttacccg

SEQ ID NO: 349868 - DNA, 676 bp, Homo sapiens
  misc_feature: GZ8MTXP02JQ06C.51.30.C08.1.454.CMB.2.raw
  modified_base (241)..(241): a, c, t, g, unknown or other
  misc_feature (241)..(241): n is a, c, g, or t
tcagcgatcgtatacacgaccggtgctcgatttagtctgacgtcaaagggaaagggggtgggctcaggaggcagagctctgggaatctcaccatggcctggaccccctctcctgctccccctcctcactttctgcacagtctctgaggcctcctatgagctgacacagtcaccctcgctgtcagtcgtccccaggacaaacggccaggatcacctgctctggagatgcattgaccaaaagntatgtcttatggtaccatcagaagtcaggcccacggcccctagtactggtcatctagtaggacgaaccaaccgaaaccggaccccgtaccgggtactaccccgtagaacgtacttcctacgtcggtacctccgtaaggtttacgggactacggttcggcccaccgtgaactagtacgacggggtcggggacccggtagggggtgggggatagggggacggggttataacgtttaacgttacgttacggttaactacgaaacgagtaaacttaactttaactacgtactacgtaaggtacgggttgtaccggggacggaggaccgtaagtcgtacggacccgtcgtacggccgaccgaccgaacgggtccctacccggtcccccttacggtccgtaccttcccgtccgttaccccctacccgttcctcgttacccg

SEQ ID NO: 349869 - DNA, 554 bp, Homo sapiens
  misc_feature: GZ8MTXP02IC7BR.51.30.C08.1.454.CMB.2.raw
  modified_base (240)..(240): a, c, t, g, unknown or other
  misc_feature (240)..(240): n is a, c, g, or t
  modified_base (413)..(413): a, c, t, g, unknown or other
  misc_feature (413)..(413): n is a, c, g, or t
tcagcgatcgtatacacgaccggtgctcgatttagtctgacgtcaaagggaaaggggtgggctcaggaggcagagctctgggaatctcaccatggcctggacccctctccctgctcccccctcctcactttctgcacagtctctgaggcctcctatgagctgacacagtcaccctgctgtcagtgtccccaggacaaacggccaggatcacctgctctggagatgcattgaccaaaaagntatgcttattggtaccatcagaagtcaggccacggcccctgtactggtcatctatgagacacaaaacgccctcgggatccacgagattctctgctccagttaggctagtgccacctgacaatcgagtggggacccagggtggggagtgagggtgagttactacgttagttacncgtaaacagactattactaacttactctaagttaggggtcgttcgggacgggagggaccgagcgtgacccgtcgtagggtcacgaccgaaacggcctaccgcccccgtacggtccactctcgtaccccaccctcctctccg

SEQ ID NO: 349870 - DNA, 601 bp, Homo sapiens
  misc_feature: GZ8MTXP02I793H.51.30.C08.1.454.CMB.2.raw
  modified_base (240)..(240): a, c, t, g, unknown or other
  misc_feature (240)..(240): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaagntatgtcttattggtaccatcagaagtcaggccacggcccctgtactggtcatctatgacgacaaccaaacgaccccgtaccgggactccctacgagtatctctcggcctccgtaggtttacgggactacggtcggcccacctagaactaatcgagggtcgggggcccgtaagggggtcgggggatgggagggtaggtaattacgtacttagttactacaaacgagactaattactactactactagttagggtgtcgggacggaggtaaccagtcgtacgaccgtcgtacggtacacgccgaacggcctccgcccccgtaggtccaccgtccttccgtccccacccttccgtacgttaccg

SEQ ID NO: 349871 - DNA, 633 bp, Homo sapiens
  misc_feature: GZ8MTXP02GVG3C.51.30.C08.1.454.CMB.2.raw
  modified_base (240)..(240): a, c, t, g, unknown or other
  misc_feature (240)..(240): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaagntatgcttattggtaccatcagaagtcaggccaggcccctgtactggtcatctatgaggacaaccgaaacgccccgtcgggactcccgtacgagtacttctctcggcctccgtagtttagggactagtcggcccaccctgacaatccgaggtcggggcccgaggggtgggggacgtggaggggtgtaagttacgtacgtaggttactacgaaacacgtaactacttaactactactacgtaagttagggtcgttcgggacgggagggaacccaaggtcgtacggaccgtacgtacggtccgacgtacccgaaacggtccgtaccgcccccgttcgggtaaccctccgtaccgttcccggttcccccgtacccccgttcccttacccgttcccgg

SEQ ID NO: 349872 - DNA, 636 bp, Homo sapiens
  misc_feature: GZ8MTXP02IIAP5.51.30.C08.1.454.CMB.2.raw
  modified_base (240)..(240): a, c, t, g, unknown or other
  misc_feature (240)..(240): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaagntatgctttattggtaccatcagaagtcaggccaggcccctgtactggtcatctatgaggaacaccaaacgaccccgtaccggatcccacgagattctctcgctccagttacggacagtcgccacctgaacatcgaggtcgggggacccaggggtgggggagttaggaggggtagtacgttaacgtacgttagtttactacgaacacgtaactaactttaactactacctacgtagtaacggggttggttacgggacggggagggaacccaaggtccgtacggacccggttaccgtaacgggtcacgtaaccccggaaaggtccgtacccgtcccccgttacgggtccctaccgttccgttaccggttcccccgtccccgttaccctcgttacccgg

SEQ ID NO: 349873 - DNA, 601 bp, Homo sapiens
  misc_feature: GZ8MTXP02JUHPF.51.30.C08.1.454.CMB.2.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
  modified_base (435)..(435): a, c, t, g, unknown or other
  misc_feature (435)..(435): n is a, c, g, or t
tcagcgatcgtatacacgaccggtgctcgatttagtctgacgtcaaagggaaagggggtgggctcaggaggcagagctctgggaatctcaccatggcctggacccctctcctgcctccccctcctcactttctgcacagtctctgaggcctcctatgagctgacacagtccaccctcgctgtcagtcgtccccaggacaaacggccaggatcacctgctctgganatcgctattgaaccaaaaagntatgtacttagttggtaccatacaagaagtcgacggccacggcccctgtactggtcatctagagagaccaaccgaaaccgcccgtccgggactcccgtagagtactctgtccggtctaccgtaggtttacgggactaggtcgccacctgacatcgagggtcgggccgtaggggtggggagtggagggtntacgttacgtattagtactacaacagactattaactactactactaggtacggtcgttcggacggacggaccgaagcgtacgaccgttacgacgtacgacgaccgacggccgttccgaccccgtcggtaacctccgttccgtccgttccccgcccttccgtctccg

SEQ ID NO: 349874 - DNA, 561 bp, Homo sapiens
  misc_feature: GZ8MTXP02IZ9T2.51.30.C08.1.454.CMB.2.raw
  modified_base (239)..(239): a, c, t, g, unknown or other
  misc_feature (239)..(239): n is a, c, g, or t
  modified_base (290)..(290): a, c, t, g, unknown or other
  misc_feature (290)..(290): n is a, c, g, or t
  modified_base (401)..(401): a, c, t, g, unknown or other
  misc_feature (401)..(401): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaagntatgcttatgtacatcagaagtcaggccacggcccctgtactgtcatctangagacacaacgaccctcggactccagagtacttctcgtcggctccgtagtttaggactagtcggccaccgtgacaatcgaggtcggggccgaggggtggggatggagggtntaagttactacgtagttacacgaactagaactattaactactactacgagttagggtcgtcggagggacggaacagcgtacgaccgtcgtacggtcacgaccgtaacgcctaccgcccccgtggtccacgttcgtccgttccccgccctccgttctaccg

SEQ ID NO: 349875 - DNA, 596 bp, Homo sapiens
  misc_feature: GZ8MTXP02JHQZA.51.30.C08.1.454.CMB.2.raw
  modified_base (239)..(239): a, c, t, g, unknown or other
  misc_feature (239)..(239): n is a, c, g, or t
  modified_base (440)..(440): a, c, t, g, unknown or other
  misc_feature (440)..(440): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaagntatgcttattggtaccatcagaagtcaggccaggcccctgtactggtcatctatgagacaccaaacgccctcgggatcccacgagtacttctcgtcggctccgtagttaggactagtcggccaccgtgacaatcgaaggtcggggacccgaggggtcgggggatagggaggggttgtaagttactacgttagttaccgtanaacgagactattaactactactacagtagggtcgttcgggacggtacgggaaccagtacgtacgaccgtccgtaggtccacgacccgaaaggtccctccgccccgttacggtccctaacgttccgtcccgttcccgccctttccccgtacgtcccg

SEQ ID NO: 349876 - DNA, 645 bp, Homo sapiens
  misc_feature: GZ8MTXP02G9XPJ.51.30.C08.1.454.CMB.2.raw
  modified_base (240)..(240): a, c, t, g, unknown or other
  misc_feature (240)..(240): n is a, c, g, or t
  modified_base (426)..(426): a, c, t, g, unknown or other
  misc_feature (426)..(426): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtcgtccccaggacaaacggccaggatcacctgctctggagatgcattgaccaaaagntatgcttatggtaccatcagaagtcaggccacggcccctgtactggtcatctatgagacaaccaaacgccctcgggactcctacgagtacttctctcggctaccgtaggtttacgggactaggtcgccctacctagaactaagtccgagggtcggggacccgaggggtcgggggatgggaggggtntagttacgtacgtagttactacgaaacagtactacttaactacttactacgtaggttaggggtcggttacgggacgggtaacgggaccgaaggtcgtacggtacccgttacgtacgggtaccgaccgacccggaaacgggtccctacccggtcccccgttcgggtaacctccgttcccgttacccgttaccccctaccccttccgttccgttaacccgg

SEQ ID NO: 349877 - DNA, 555 bp, Homo sapiens
  misc_feature: GZ8MTXP02GV8TU.51.30.C08.1.454.CMB.2.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (406)..(406): a, c, t, g, unknown or other
  misc_feature (406)..(406): n is a, c, g, or t
  modified_base (424)..(424): a, c, t, g, unknown or other
  misc_feature (424)..(424): n is a, c, g, or t
  modified_base (528)..(528): a, c, t, g, unknown or other
  misc_feature (528)..(528): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcactgctctgganatgcattgaccaaaagntatgcttatggaccatcagatcaggccaggcccctgtactggtcatctatgagacaccaaacgccctccgggatcccagagtatctcgcggctccagtttacgggactaggtcggccaccctgaaccaatccgaggtcggggcccgagggtcgggggatggaggggtnaagttacactgttactanaacgagactattactactactctagttaggtgttacgggcggagggaccgtaagctaggaccgtactagggtccagcccaacggcctccgccccgtcggtaacncgtcctcgtccccaccgtcctcctccg

SEQ ID NO: 349878 - DNA, 762 bp, Homo sapiens
  misc_feature: GZ8MTXP02JFPHU.51.30.C08.1.454.CMB.2.raw
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtccaccctcgctgtcagtcgtccccaggacaacggccaggatcatctgctctggagatgctattgaaccaaaagataatgtcttattggtaccatcaagagtcaggccacggcccctgtactggtcatctatcggacggaaccaaccgaaaccgtaccccgtaccgggacctccccgtaacgacgtacttctaccgtcgtcctaccgtaaggtttacgggactagggtccggaccctacccgtaggaaccaagtcgacggggttccgggggacccggtagggggttacgggggtaggtaggggtaggggttagtaagtttaccgttaacgttacggtttaccacgtaaaccgtaaggtaaccttaaagtttaacccttaaccgttaacgttaccgtaaaggttacgggggttacggttaccggggaccggggtaacgggtaaacccgtaacggtacccggtaccggtaaccccggttaccgttacgggtaccgtaaaccggaccccggtaaccggtacccgtcccggtacccccgttccggtccctaacccgttcccgtttcccgttacccccgttacccccttaccgtttcccg

SEQ ID NO: 349879 - DNA, 530 bp, Homo sapiens
  misc_feature: GZ8MTXP02FK9R2.51.30.C08.1.454.CMB.2.raw
  modified_base (240)..(240): a, c, t, g, unknown or other
  misc_feature (240)..(240): n is a, c, g, or t
  modified_base (526)..(526): a, c, t, g, unknown or other
  misc_feature (526)..(526): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaagntatgcttattggtaccatcagaagtcaggccaggcccctgtactggtcatctatgaggacaccaaacgccctcgggatccctacgagattctctggctccagtttagggacagtggccaccctgacaatcagtcggggcccagggtgggggatggagggtgaattacacttgttactcaaacagaactattactactactcagtagggtgttcggcggagggaccaagctgaccgtcgtaggtcacgccaaggcctcgccccctggtcactctcgttcccacctcnctcg

SEQ ID NO: 349880 - DNA, 684 bp, Homo sapiens
  misc_feature: GZ8MTXP02FXATD.51.30.C08.1.454.CMB.2.raw
  modified_base (239)..(239): a, c, t, g, unknown or other
  misc_feature (239)..(239): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaagntatgcttattggtaccatcagaagtcaggccaggcccctgtactggtcatctatgagacaccaaacgccctcgggatcccgtagagacttctcgtcggcctccgtaggtttacggactaggtcggcccacctgacaagtcgaagggtcggggaccaggggtgggggactgggagggttgtaagtttaccgtacgttacggttaactacgaaaacgtacgaaaccttaattaaacctaaccttaacttaccgtaagggttaagggggttccgttacgggggaacggggaacgggtaaaccccgaaggtccgtaccgggaacccgttaccggtaacgggtaccgaacggaccccgtaaagggtccccgtcccggccccccgttacgggtccctaccgttcccgttcccgggttccccccgaccccgtttccccttcggttaacccgg

SEQ ID NO: 349881 - DNA, 722 bp, Homo sapiens
  misc_feature: GZ8MTXP02JZUF4.51.30.C08.1.454.CMB.2.raw
  modified_base (239)..(239): a, c, t, g, unknown or other
  misc_feature (239)..(239): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaagntatgcttatggtaccatcagaagtcaggccaggcccctgtactggtcatctatgagacaccaaacgccctcgggatccctagagtattctcgtcggcctcgtaggttacggctacggtcgccctaccgtagaactaagtcgaggggtccggggacccgtagggggtaggggtaagtggggtaaggggtagttaacgtttaccgtaacggttacgtttaaacgtacaaacgtaacgtaaacttaaactttaacctaacttaacgtaccgtaaagggtttacggggtcggtttaccggggacgggggtaaaccgggtaaccgaaagggtcccgttacgggtaaccccggtttaccggaacgggttaccgacccgtacccggaacgggtcccgtaccccggtccccccggttcgggtaaccctaacccggtttcccgttccccgggttaacccccgtcccctttacccgttcccgtttaacccggg

SEQ ID NO: 349882 - DNA, 653 bp, Homo sapiens
  misc_feature: GZ8MTXP02FZEZC.51.30.C08.1.454.CMB.2.raw
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaagatatgcttattggtaccatcagaagtcaggccacggcccctgtactggtcatctatgacggacaaccaaacgaccctacccgggactcccgtacgagtacttctcgtggcctaccgtaggtttacgggactacggtcgggccaccgtggaacaacgtcgaagggtcgggggacccagggggttgggggatagggaaggggtgtaaagtttacgtactttaggttaacctacgaaactaggtaaccttaagttacctaactacgttaccgtaggttaagggttcggttacggggacgggaagggaccgtaaacggtcgtacgtaaacccgttcgtacggtacgaccggacccgtaaggcccttacccgggcccttcggtaacctctccgttccgttacccctccctcctcgtaccg

SEQ ID NO: 349883 - DNA, 586 bp, Homo sapiens
  misc_feature: GZ8MTXP02FYIG5.51.30.C08.1.454.CMB.2.raw
  modified_base (238)..(238): a, c, t, g, unknown or other
  misc_feature (238)..(238): n is a, c, g, or t
  modified_base (407)..(407): a, c, t, g, unknown or other
  misc_feature (407)..(407): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgacaaaagntatgcttattggtaccatcagaatcaggccaggcccctgtactggcatctatgagacacaaccgcctcgggactcctacgagattctctcggcctccgtagtttaggacagtcggcccacctgaacaactcgaggtcggggcccagggggtcgggggatgggaggggtntagttaactacgttgttaactacgaaacagtaactaattactaactactcaaggtaggtgttcggacggtagggaaccagcgtacgaccgtcgtaggtacacggtacccaagggtcctccggcccccgtacggtcctaccgttccgtcccggttcccctccccgtaccttccgtaccgg

SEQ ID NO: 349884 - DNA, 665 bp, Homo sapiens
  misc_feature: GZ8MTXP02H36YM.51.30.C08.1.454.CMB.2.raw
  modified_base (239)..(239): a, c, t, g, unknown or other
  misc_feature (239)..(239): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtcccaggacaaacgccaggatcacctgctctggagatgctattgaccaaaaagntatgacttagtaggtaccatcaagaagtcacggccaggcccctgtactggtcatctatgaaggacaccgtaaaacgccctcgggactacccgtagagtacttctactcggcctaccgtagtttacggggactaggttcgccctacccgtagaaccatcgaacgggtcgggacccgagggtgggggatgggtaagggtagtacgtttaacgtacgttagttaacaacgaacgaataactactttaactacgttaactcgtaaggtagggttggttaccgggacgggtaacgggaccgtaaacgcgtacggacccgttaccgtaaggtaccgaaccgacccgtaacgggcctaccccggtcccccgtaccggtcctaaccgtcccgtacccggttacccccggtcccgttacccttaccgttacccgg

SEQ ID NO: 349885 - DNA, 629 bp, Homo sapiens
  misc_feature: GZ8MTXP02JW9DS.51.30.C08.1.454.CMB.2.raw
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
  modified_base (310)..(310): a, c, t, g, unknown or other
  misc_feature (310)..(310): n is a, c, g, or t
  modified_base (329)..(329): a, c, t, g, unknown or other
  misc_feature (329)..(329): n is a, c, g, or t
tcagcgatcgtatacacgaccggtgctcgatttagtctgacgtcaaagggaaagggggtgggctcaggaggcagagctctgggaatctcaccatggcctggacccctctcctgctcccctcctcactttctgcacagtctctgaggcctcctatgagctgacacagtcaccctcgctgtcagtgtccccaggacaaacggccaggatcacctgctctgganatgcattgacaaaagntatgcttattggtaccatcagaagtcgaggccaggcccctgtactggtcatctatgagacaaccaaacgcccncgggactccacgagattcnctcgctcctaggttaggactaggcggcccacccgtgaactaatcgacgggtcggggacccgagggggtgggggataggggaggggtagtacgttaacgtacggttacgttaactaccaaaacgtacgtaactaaacttttaacctactacttaccgaaggtttaggggttggttacgggaccggggaagggtaaccgagccgtaggacccgtcgtacgggtacacggtaccgaacggcctaccggcccccttcgggtaacctacctcccgttcgtaccccctcccttccgtccttaccgg

SEQ ID NO: 349886 - DNA, 761 bp, Homo sapiens
  misc_feature: GZ8MTXP02FVBZ8.51.30.C08.1.454.CMB.2.raw
  modified_base (243)..(243): a, c, t, g, unknown or other
  misc_feature (243)..(243): n is a, c, g, or t
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtcgtcccaggacaacggccaggatcacctgctctggagatgctattacgaaccaaaagtntatgtacttagttggtaaccatacgaagaacgtcgacggccacggccctgtactggtcatcgtagtagaacgtaaccaaaccgaaaccgaccccgtaccgggaccttacccgtaacgtaacgtacttccgtcgtccggtaccttaccgtaagggtttacggacgtacgtccgggccccgtacccgtagaaaccgtaacgtcgggtacgggtaccgggggacccggtagggggtagggggtaaggtggggtaacgggtacggttaagtttaaccgttacgttagtttaaccctaacgaaaccgtagttaaacctaactttaaaccgtactttacgtagtaagggtttacggggtacgggttaccggggacgggacggggaaacctaaggccgttaacgggtacccgttacggtaacggacgtaacccggaccgtaacggccgttaccccggcccccgttacggtaaccgttacccgttccgttacccggtccccctaaccggttcccctacgtacccgg

SEQ ID NO: 349887 - DNA, 770 bp, Homo sapiens
  misc_feature: GZ8MTXP02H2LC6.51.30.C08.1.454.CMB.2.raw
tcagcgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtcgtaccccaggacaaacggccaggatcacctgctctggagatgctagttagaaccaaaaagatatagtactttaagttacggtaacctaatcaaggaagtacgacggaccgacggcccctagtacctcggtacacgttactagtacggaacggaaccaaacccgaaaaccgtaccccgtaaccgggtacttacccgtaacgaagtactttacctcgtcggtcctaccgtaggtttaacgggactacgggttcgcccacccgttacgaacctaaacgcgtaacgggtcgggggaaccccgtagggggttagggggacgttaggggaggggttaacgtaagtttaaacgttacgtttacgttaaccaaccgtaaaacacgtaaaactaatttaaacctaacttaacgtctaaagggtcgggttacggttacggggacgggaacgggaaaccgaaacgtcgtaacggaaccgttacgtacgggtaccaacggacccgtaaacgggtcctacccgggtcccccgtacgggtaaccctaacccgttcggttaccccgtttacccccgaccccgtttccgtaacccttccgg

SEQ ID NO: 349888 - DNA, 515 bp, Homo sapiens
  misc_feature: GZ8MTXP01DYDKG.44.78.H01.1.454.CMB.2.raw
  modified_base (264)..(264): a, c, t, g, unknown or other
  misc_feature (264)..(264): n is a, c, g, or t
  modified_base (394)..(394): a, c, t, g, unknown or other
  misc_feature (394)..(394): n is a, c, g, or t
  modified_base (458)..(458): a, c, t, g, unknown or other
  misc_feature (458)..(458): n is a, c, g, or t
  modified_base (500)..(500): a, c, t, g, unknown or other
  misc_feature (500)..(500): n is a, c, g, or t
  modified_base (510)..(510): a, c, t, g, unknown or other
  misc_feature (510)..(510): n is a, c, g, or t
  modified_base (513)..(513): a, c, t, g, unknown or other
  misc_feature (513)..(513): n is a, c, g, or t
tcagacagtatatacacgaccggtgctcgatttagtgtgagtagtttgggtttggggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctggggaaaacttgagtgataaatttgcttctgtatcagcagagcaggccagcccctangctggtcatctttcaggataataaagcggccctcagggatccctgagcgcttctctggctccaactcctgggaacacggccactctgaaccatcagcgcgaccagcctctggatgaggctgactattacngtcagacgtagggaaagtggacttaagttgggtgttcggcggagggaccaaagctggaccgttncggtcagcccaaggcctcgccccttcggcacgtctcgtcccnccctcttctnttntc

SEQ ID NO: 349889 - DNA, 524 bp, Homo sapiens
  misc_feature: GZ8MTXP01DLHUX.44.78.H01.1.454.CMB.2.raw
  modified_base (415)..(415): a, c, t, g, unknown or other
  misc_feature (415)..(415): n is a, c, g, or t
  modified_base (492)..(492): a, c, t, g, unknown or other
  misc_feature (492)..(492): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacgggcttgcccagaagttccaaggcagagtagtatgaccaggagcacctccccaggtacagtctacatggaactgagcagcctgagatctgacggacacggccgtgtatttctgtgcgagacgccacagcacctggcttgacttggtggggccaggggaccctggtcaccgtctctcncgcctccacaatcggcccagtccggtccttccccgtggccgccctggcctccgaggcgccaccgtccgagacgcacnggccggccctgggccttgcccgttgggtaacg

SEQ ID NO: 349890 - DNA, 518 bp, Homo sapiens
  misc_feature: GZ8MTXP01D8KTE.44.78.H01.1.454.CMB.2.raw
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
  modified_base (486)..(486): a, c, t, g, unknown or other
  misc_feature (486)..(486): n is a, c, g, or t
  modified_base (503)..(503): a, c, t, g, unknown or other
  misc_feature (503)..(503): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagtccaaggcagagttagtatgaccaggagcacctccccaggtacagtctacatggaactgagcagcctgagatctgaggaacacggccgtgtatttctgtgcgagagccacagcacctggcttgacttgtgggcagggaccctgtcacggtctctcacgcctccaccaaggcccatccggtctccccnggccncccttgccttccgaggacgccnccttccgaagacgcacngcggcccgttgggcc

SEQ ID NO: 349891 - DNA, 521 bp, Homo sapiens
  misc_feature: GZ8MTXP01B12PF.44.78.H01.1.454.CMB.2.raw
  modified_base (311)..(311): a, c, t, g, unknown or other
  misc_feature (311)..(311): n is a, c, g, or t
  modified_base (353)..(353): a, c, t, g, unknown or other
  misc_feature (353)..(353): n is a, c, g, or t
  modified_base (387)..(387): a, c, t, g, unknown or other
  misc_feature (387)..(387): n is a, c, g, or t
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
tcagacagtatatacacgaccggtgctcgatttagtgtgagtagtttgggtttgggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctggggaaaacttgagtgattaaattgcttcctggtatcagcagaggccaggccagccccctatgctggtcatctttcaggataataagcgcctnagggatccctgagcgcttctcctggctcaactctagggaacncggccactctgaccatcagcgcgacccagcctcnggatgaggctgactattatgtcgagtacgtgggaaagtgcgtaagttgggtagttcggcggaggaccgaagcgtgaccgttcncggtcncgcccgagcctcgcccctggtccacgttcctcgttcccctaaccc

SEQ ID NO: 349892 - DNA, 527 bp, Homo sapiens
  misc_feature: GZ8MTXP01A2355.44.78.H01.1.454.CMB.2.raw
  modified_base (347)..(347): a, c, t, g, unknown or other
  misc_feature (347)..(347): n is a, c, g, or t
tcagacagtatatacacgaccggtgctcgatttagtgtgagtagtttgggtttgggctgggcctcaggaagcagcatcggaggtgcctcagccatggcatggatccctctcttcctcggcgtccttgcttactgcacagggtctggggcctcctctgacctgactcagccatcctcactgtccgtgtccccaggacacacagtcactattacctgctctgggaaacttgagtgataattgcttctgtatcagcagagcaggccagcccctatgctggtcatctttcaggataataagcggccctcagggatccctgagcgcttcctctggctccaactctgggaacncggccactctgacatcagcgcgacccagcctctggatgaggctgactattactggtcagtaccgtagggaaagtgacgttaagttggggtagttcgggcgggagggaccgaagcgttcggaccgttcgtcggtcacgcccgaggtcctcggcccctcgggtcaccgttcttccgttcccc

SEQ ID NO: 349893 - DNA, 535 bp, Homo sapiens
  misc_feature: GZ8MTXP01BI95B.44.78.H01.1.454.CMB.2.raw
  modified_base (354)..(354): a, c, t, g, unknown or other
  misc_feature (354)..(354): n is a, c, g, or t
tcagacagtatatacacgaccggtgctcgatttagtgtgagtagtttgggtttgggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctggggaaacttgagtgataaattgcttcctggtatcagcagaggccaggccagccccctatgctggtcatcttcaggataataagcggccctcagggatccctgagcgcttctcctggctccaactctagggaaccncggccacgtctgaccatcagcgcgacccagcctctggatgaggctgactattacgtgtcgaggacggtgggaaagtgacgttaagttggggtaggttcgggcgggagggaccaaggctggaccgttcgttcggtcagttcccgaggcctgccccctggtccacttctcgttcccctaaccc

SEQ ID NO: 349894 - DNA, 536 bp, Homo sapiens
  misc_feature: GZ8MTXP01AV9Z9.44.78.H01.1.454.CMB.2.raw
  modified_base (501)..(501): a, c, t, g, unknown or other
  misc_feature (501)..(501): n is a, c, g, or t
  modified_base (518)..(518): a, c, t, g, unknown or other
  misc_feature (518)..(518): n is a, c, g, or t
tcagacagtatatacacgaccggtgctcgatttagtgtgagtagtttgggtttggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagtccaaggcagagttagtatgaccaggagcacctccccaggtacagtctacatggaactgagcagcctgagatctgaggaacacgggccgtgtatttctgtgcgagagccacagcacctggcttgacttgtggggccagggaaccctgggtcaccgggtctccgtcacgcctccaccaacgggcccatccggtccttccccgtggccgcccttggccttccgaggcgccnccttccgaagagccacngccggtcccttgggggcc

SEQ ID NO: 349895 - DNA, 505 bp, Homo sapiens
  misc_feature: GZ8MTXP01DKF31.44.78.H01.1.454.CMB.2.raw
  modified_base (299)..(299): a, c, t, g, unknown or other
  misc_feature (299)..(299): n is a, c, g, or t
  modified_base (356)..(356): a, c, t, g, unknown or other
  misc_feature (356)..(356): n is a, c, g, or t
  modified_base (371)..(371): a, c, t, g, unknown or other
  misc_feature (371)..(371): n is a, c, g, or t
  modified_base (404)..(404): a, c, t, g, unknown or other
  misc_feature (404)..(404): n is a, c, g, or t
  modified_base (474)..(474): a, c, t, g, unknown or other
  misc_feature (474)..(474): n is a, c, g, or t
  modified_base (479)..(479): a, c, t, g, unknown or other
  misc_feature (479)..(479): n is a, c, g, or t
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
tcagacagtatatacacgaccggtgctcgatttagtgtgagtagtttgggtttggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagtccaaggcagagttagtatgatcaaggngcacctccccaggtacagtctacatggaactgagcagcccctgagatctgaaggacncggccgtgtatttcngtgcgagagccaccagcacctggcttgacttgngggccagggaaccctggtcaccgtctcctcagcctcacaaggcccatcgtctcccctgcgccctgctccnggacncaccncgagcncacncgccgccgtgg

SEQ ID NO: 349896 - DNA, 540 bp, Homo sapiens
  misc_feature: GZ8MTXP01BZMM4.44.78.H01.1.454.CMB.2.raw
  modified_base (372)..(372): a, c, t, g, unknown or other
  misc_feature (372)..(372): n is a, c, g, or t
  modified_base (487)..(487): a, c, t, g, unknown or other
  misc_feature (487)..(487): n is a, c, g, or t
  modified_base (506)..(506): a, c, t, g, unknown or other
  misc_feature (506)..(506): n is a, c, g, or t
  modified_base (521)..(521): a, c, t, g, unknown or other
  misc_feature (521)..(521): n is a, c, g, or t
  modified_base (524)..(524): a, c, t, g, unknown or other
  misc_feature (524)..(524): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagtccaaggcagagttagtatgaccaggagccaccctccccaggtacagtctacatggaactgagcagcctgagatcgtgaggaacacgggcgtgtatttcngtgcgagacgccacagcacgtggcttggacttggtggggccagggaccctgggtccaccgggtctcctcacgccctcccaccgacgggcccattccggtccttccccgtggcccncccttggccttccgaggcncgccttcgaagcgcncgngccggcccgttgggcc

SEQ ID NO: 349897 - DNA, 514 bp, Homo sapiens
  misc_feature: GZ8MTXP01ES5KY.44.78.H01.1.454.CMB.2.raw
  modified_base (350)..(350): a, c, t, g, unknown or other
  misc_feature (350)..(350): n is a, c, g, or t
  modified_base (394)..(394): a, c, t, g, unknown or other
  misc_feature (394)..(394): n is a, c, g, or t
  modified_base (443)..(443): a, c, t, g, unknown or other
  misc_feature (443)..(443): n is a, c, g, or t
  modified_base (468)..(468): a, c, t, g, unknown or other
  misc_feature (468)..(468): n is a, c, g, or t
tcagacagtatatacacgaccggtgctcgatttagtgtgagtagtttgggtttgggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactatacctgctctgggaaacttgagtgataattgcttctggtatcagcagaggcaggccagccccctatgctggtcatcttcaggataataagcggccctcgagggatccctgagcgcttctcctggctccaactctagggaacncggcactctgaccatcacgcgcgacccagcctctggatgaggcngactattactgtcgagacgtgggaaagtgcgtaagttgggtagtcgggnggagggaccaaggctggaccgttcncggtcacgcccgagcctcgcccctggtcacttctcgttcccaaccc

SEQ ID NO: 349898 - DNA, 545 bp, Homo sapiens
  misc_feature: GZ8MTXP01BS0X6.44.78.H01.1.454.CMB.2.raw
  modified_base (267)..(267): a, c, t, g, unknown or other
  misc_feature (267)..(267): n is a, c, g, or t
  modified_base (299)..(299): a, c, t, g, unknown or other
  misc_feature (299)..(299): n is a, c, g, or t
  modified_base (464)..(464): a, c, t, g, unknown or other
  misc_feature (464)..(464): n is a, c, g, or t
  modified_base (522)..(522): a, c, t, g, unknown or other
  misc_feature (522)..(522): n is a, c, g, or t
tcagacagtatatacacgaccggtgctcgatttagtgtgagtagtttgggtttggggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctggggaaaacttgagtgataaatttgcttcctggtatcagcagagccaggccagcccctangctggtcatcttcaggataataagcggccctnagggatccctgagcgcttctctggctccaactctgggaacacggccactctgccatcagcgcgacccagccctctggatgaggctgactattactgtcagacgtgggaaagtggacttaaagttggggtagttcgggcggagggaccaaaggctggacccgttcnccgggtcacggccccaaagggcctcgcccccgttgggttccaccgtctcggttccccnccctccttctaacttgttaaccg

SEQ ID NO: 349899 - DNA, 529 bp, Homo sapiens
  misc_feature: GZ8MTXP01EW0GH.44.78.H01.1.454.CMB.2.raw
  modified_base (267)..(267): a, c, t, g, unknown or other
  misc_feature (267)..(267): n is a, c, g, or t
  modified_base (398)..(398): a, c, t, g, unknown or other
  misc_feature (398)..(398): n is a, c, g, or t
  modified_base (465)..(465): a, c, t, g, unknown or other
  misc_feature (465)..(465): n is a, c, g, or t
  modified_base (509)..(509): a, c, t, g, unknown or other
  misc_feature (509)..(509): n is a, c, g, or t
tcagacagtatatacacgaccggtgctcgatttagtgtgagtagtttgggtttggggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctggggaaaacttgagtgataaattgcttctggtatcagcagaggccaggccagccccctangctggtcatctttcaggataataaagcggccctcagggatccctgagcgcttctctggctccaactcctgggaacacggccactctcgccatcagcgcgacccagccctctggatgaggctgactattacngtcagacgtagggaaagtggacgttaaagttggggtgttcgggcggagggaccaagctgaccgttcncggtcagcccgaaggcctgccccttcggttcactctcgttcccncctaccttctaattcgtaac

SEQ ID NO: 349900 - DNA, 511 bp, Homo sapiens
  misc_feature: GZ8MTXP01EF2C9.44.78.H01.1.454.CMB.2.raw
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtctggggcctcctctgacctgactcagccatcctcactgtccgtgtccccaggacacacagtcactattacctgctctgggaaacttgagtgataaatttgcttctgtatcagcagaggcaggccagcccctatgctggtcatctttcaggataataagcggccctcgagggactccctgagcgcttcctctggctccaactcgtagggaacacggccactctgaccatcagcgcgacccagcctctggatgagctgactatactgtcagacgtaggaaagtgactaagtgggtgttcgggcggaggaccaagcgttggaccgttcgcggtcacgcccaaggctcgcccctggtcactcgttcgtcccc

SEQ ID NO: 349901 - DNA, 521 bp, Homo sapiens
  misc_feature: GZ8MTXP01DSQ6R.44.78.H01.1.454.CMB.2.raw
  modified_base (353)..(353): a, c, t, g, unknown or other
  misc_feature (353)..(353): n is a, c, g, or t
tcagacagtatatacacgaccggtgctcgatttagtgtgagtagtttgggtttgggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctggggaaacttgagtgataaattgcttctgtatcagcagaggccaggccagccccctatgctggtcatctttcaggataataagcggccctcagggatccctgacgcgcttctctggctccaactcgtagggaacncggccactctgaccatcagcgcacccagcctctggatgaggctgactatactgtcgaggacgtagggaaagtgctaagttgggtagttcggacgggagggaccaaggctcgaccgttcgcggtcagcccgaaggctcgcccctggtccacgttctcgttccctaaccc

SEQ ID NO: 349902 - DNA, 542 bp, Homo sapiens
  misc_feature: GZ8MTXP01DR91X.44.78.H01.1.454.CMB.2.raw
  modified_base (411)..(411): a, c, t, g, unknown or other
  misc_feature (411)..(411): n is a, c, g, or t
  modified_base (458)..(458): a, c, t, g, unknown or other
  misc_feature (458)..(458): n is a, c, g, or t
  modified_base (537)..(537): a, c, t, g, unknown or other
  misc_feature (537)..(537): n is a, c, g, or t
tcagacagtatatacacgaccggtgctcgatttagtgtgagtagtttgggtttggggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcgacaattccactggccctttaaagtctctatcatggtacgcagtggtcccggccgagcccccaaagtcctctttacgacgtcctttcgcggcttcggcagtccctggccgttttcggcctccagttctgaccacgcgcctcctgaccatcacaaactccgctgagatgaggctgactactttgttntgcatatttcgatttcactcaaatatgtcttcggaaggtgggacccngtcagcgtcctgcgtcagcccaaggcccaaaccccacttgtcactctcttcccacccttcctctataatactgttctgngcggg

SEQ ID NO: 349903 - DNA, 634 bp, Homo sapiens
  misc_feature: GZ8MTXP01BRSZ9.44.78.H01.1.454.CMB.2.raw
  modified_base (272)..(272): a, c, t, g, unknown or other
  misc_feature (272)..(272): n is a, c, g, or t
  modified_base (363)..(363): a, c, t, g, unknown or other
  misc_feature (363)..(363): n is a, c, g, or t
tcagacagtatatacacgaccggtgctcgatttagtgtgagtagtttgggtttggggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctcgtaggggaaaacttgagtgtataaatttgcttctggtatcagcagaggccaggccacgcccctangctggtcatctttcaggataataagccggcctcgacgggactcccgtggacgccgtctttctctcggcctaccaactccgtaggggaaacncggcccactctcgaacccatccgagccgaccgacccagcctcgtggacgtggacgggtctacggtaacttactttaacgtggtacacgggtacggtaggggtaaaggttcgggtacgttaaaggtttggggttgggttacgggcgggtaacggggaccaaagggtctcggtacccgttcgtccgggtcacggacccgaacgggccgtccggcccccgttcggttccaccgttcctaccgttcccctaccctccttacttaacttcttaacg

SEQ ID NO: 349904 - DNA, 558 bp, Homo sapiens
  misc_feature: GZ8MTXP01DXGO7.44.78.H01.1.454.CMB.2.raw
  modified_base (302)..(302): a, c, t, g, unknown or other
  misc_feature (302)..(302): n is a, c, g, or t
  modified_base (389)..(389): a, c, t, g, unknown or other
  misc_feature (389)..(389): n is a, c, g, or t
  modified_base (518)..(518): a, c, t, g, unknown or other
  misc_feature (518)..(518): n is a, c, g, or t
  modified_base (534)..(534): a, c, t, g, unknown or other
  misc_feature (534)..(534): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagtccaaggcagagttagtatgaccaggancacctccccaggtacagtctacatggaactgagcagcctgagatcgtgaggaacacggccgtgtatttcgtgtgcgagacgcccacngcaccgtggcttgacttggtcggggaccacggggaaccctggtcccaccgggtctccctcacgccctccgaccaacgggcccacgtccgggtccctcccccgtggcccgtcccttgcccttccgaggcnccgccttccgaagacncgacgacgccggccgttgggtccg

SEQ ID NO: 349905 - DNA, 541 bp, Homo sapiens
  misc_feature: GZ8MTXP01DD7LA.44.78.H01.1.454.CMB.2.raw
  modified_base (502)..(502): a, c, t, g, unknown or other
  misc_feature (502)..(502): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagtccaaggcagagttagtatgaccaggagcacctccccaggtacagtctacatggaactgagcagcctgagatctgaggaacacggccgtgtatttctgtgcgagagccacagcacctggcttgacttggtggggccagggaaccctggtccaccgggtctcctcacgcctccgaccaacgggcccagtccgtccttcccccgtggcccgcccttggcccttccgaggcnccgccttccgaagacgcacacgccggcccgttggggccc

SEQ ID NO: 349906 - DNA, 543 bp, Homo sapiens
  misc_feature: GZ8MTXP01BGGRU.44.78.H01.1.454.CMB.2.raw
  modified_base (343)..(343): a, c, t, g, unknown or other
  misc_feature (343)..(343): n is a, c, g, or t
  modified_base (507)..(507): a, c, t, g, unknown or other
  misc_feature (507)..(507): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagtccaaggcagagttagtatgaccaggagcacctccccaggtacagtctacatggaactgagcagcctganatctgaggaacacggccgtgtatttctgtgcgagacgccacagcacgtggcttgacttggtcgggccagggaaccctggtccaccgggtctcctcacgccctccaccaacgggcccagtcccggtcctccccgtggcccgcccttcgccttccgacggacgccnccttccgaagacgccacgcgccggcccgttgggccg

SEQ ID NO: 349907 - DNA, 546 bp, Homo sapiens
  misc_feature: GZ8MTXP01CYEUE.44.78.H01.1.454.CMB.2.raw
  modified_base (357)..(357): a, c, t, g, unknown or other
  misc_feature (357)..(357): n is a, c, g, or t
  modified_base (393)..(393): a, c, t, g, unknown or other
  misc_feature (393)..(393): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctggggaaacttgagtgataaatttgcttctggtatcagcagaggccaggccagccccctatgctggtcatctttcaggataataagcgccctcgagggatccctgagcgcttctcctggctcaactcgtacgggaacncggccactctcgaccatcacgccgcgacccagcctntcggatgaggctagactattactgtcgagtacggtagggaaacgtgacgtaagttgggtgttcgggcggtagggaccaggctcgaccgttcgacggtcacggcccgaggcctccgcccccgtcggtccaccgttctccgttccccgtaacccc

SEQ ID NO: 349908 - DNA, 537 bp, Homo sapiens
  misc_feature: GZ8MTXP01EQ63F.44.78.H01.1.454.CMB.2.raw
  modified_base (343)..(343): a, c, t, g, unknown or other
  misc_feature (343)..(343): n is a, c, g, or t
  modified_base (485)..(485): a, c, t, g, unknown or other
  misc_feature (485)..(485): n is a, c, g, or t
  modified_base (503)..(503): a, c, t, g, unknown or other
  misc_feature (503)..(503): n is a, c, g, or t
  modified_base (509)..(509): a, c, t, g, unknown or other
  misc_feature (509)..(509): n is a, c, g, or t
  modified_base (512)..(512): a, c, t, g, unknown or other
  misc_feature (512)..(512): n is a, c, g, or t
  modified_base (520)..(520): a, c, t, g, unknown or other
  misc_feature (520)..(520): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagtccaaggcagagttagtatgaccaggagcacctccccaggtacagtctacatggaactgagcagcctganatctgaggaacacggcgtgtatttctgtgcgagacgccaccagcaccgtggcttgactttggcggggtccacgggaaccctggtccaccggggtctcctcacgccctccaccgaaggcccacgtccgtcctccccgtggccncccttgccttccgaggcnccgccncgngacgcacncgccggtccgttgggcc

SEQ ID NO: 349909 - DNA, 541 bp, Homo sapiens
  misc_feature: GZ8MTXP01AOD3F.44.78.H01.1.454.CMB.2.raw
  modified_base (481)..(481): a, c, t, g, unknown or other
  misc_feature (481)..(481): n is a, c, g, or t
  modified_base (486)..(486): a, c, t, g, unknown or other
  misc_feature (486)..(486): n is a, c, g, or t
  modified_base (505)..(505): a, c, t, g, unknown or other
  misc_feature (505)..(505): n is a, c, g, or t
  modified_base (525)..(525): a, c, t, g, unknown or other
  misc_feature (525)..(525): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacggctttgcccagaagtccaaggcagagttagtatgaccaggagcacctccccaggtacagtctacatggaactgagcagcctgagatctgaggaacacgggccgtgtatttctgtgcgagacgcccacagcaccgtggcttgacttggcgggccaggggaaccctggtccaccgggtctcctcacgccctccaccgaacgggcccagtccggtccttcccccgnggccncccttgccttccgacggcnccgaccttcgaagacgcacncggccgccgttgggcc

SEQ ID NO: 349910 - DNA, 632 bp, Homo sapiens
  misc_feature: GZ8MTXP01D2ARS.44.78.H01.1.454.CMB.2.raw
  modified_base (524)..(524): a, c, t, g, unknown or other
  misc_feature (524)..(524): n is a, c, g, or t
  modified_base (555)..(555): a, c, t, g, unknown or other
  misc_feature (555)..(555): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagtagatgaccaggagcacctccccaggtacagtctacatggaactgagcagcctgagatcgtggacggacacggccgtgttactttcgtgtcggacgagacgcccaccgagccacccgtgggctttggacgttgggtcggggacccgtaacgggggtaacccctgggtacccacccggttcctcccgtacaccggtccccttacccgaaacccggtaaaccggggcccctaagttccccgggtccctttccccccgngggccctccccgttggccctccgaagggccncccaacccgttccgaaagcgccgttaacgcgggcccggcccgtggggcctcggacccgttggaaccgtaaaaccggg

SEQ ID NO: 349911 - DNA, 617 bp, Homo sapiens
  misc_feature: GZ8MTXP01DTBLO.44.78.H01.1.454.CMB.2.raw
  modified_base (332)..(332): a, c, t, g, unknown or other
  misc_feature (332)..(332): n is a, c, g, or t
  modified_base (346)..(346): a, c, t, g, unknown or other
  misc_feature (346)..(346): n is a, c, g, or t
  modified_base (515)..(515): a, c, t, g, unknown or other
  misc_feature (515)..(515): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacgacgggcttgcccagaagtccaaggcagagtagtatgacaggagcacctccccaggtacagtctacatggaactgancagcctgagatcgngacggaacacggtccgtgtatttcgtgtgcgagacgccacagcacgtggtcttgacgtttggacggggccaacgggtaaccctcgggtacctaccggggtccttcccgtcgacgcccacccgaacccgaaacggggcccctaacgttcccggttcccgtttccccccgngggtccccgtcccgttcggcccgttaccgaacgggacgcccgacccgttcccggaacgaccgccgaaccgtaccggcccggggtccccgttcgggggtcccg

SEQ ID NO: 349912 - DNA, 765 bp, Homo sapiens
  misc_feature: GZ8MTXP01D73RN.44.78.H01.1.454.CMB.2.raw
  modified_base (714)..(714): a, c, t, g, unknown or other
  misc_feature (714)..(714): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctccgacctgactcagccatcctcactgtccgtgtcccacgacgacacacgtcactacttaccttacgtctcttagggtaaacggtaagttaggtagtattaaattttaagttcgttccttacggttagttacagacgacggaggaccggacggaccgaccgacccccgtaccctgtcgtcggttcgtacttactttaccgttaggaagtaaataacggtacggccccgtacctaggacgtacctcgagcgtcttcttctcgcgtcctaactacgtcggaaaccgacgcccgacctaccgttcgaccgactacgacgacgccgacccacgtccctcgtaggaggtacgtcgggactcgtactaaactttacgttacgtccgtaaggggaaccggggttaagggggtaaaacgtcgtccgtttaaaggtttggggggttcggtttaccggggacgggggaaccgggaaaccgtacgtaaggttcccgttccggtttaccggtcgttaccggaaccgtaaccccggggaacgttccttccccggtaacccccgtccccgggttnttaaccccgtccgttttcccggtttaacccccttaaccccccgtttaaccc

SEQ ID NO: 349913 - DNA, 548 bp, Homo sapiens
  misc_feature: GZ8MTXP01EZHJL.44.78.H01.1.454.CMB.2.raw
  modified_base (350)..(350): a, c, t, g, unknown or other
  misc_feature (350)..(350): n is a, c, g, or t
  modified_base (463)..(463): a, c, t, g, unknown or other
  misc_feature (463)..(463): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacgggcttgcccagaagttccaaggcagagtagtatgaccaggagcacctccccaggtacagtctacatggaactgagcagcctgagatctgacggacacggccgtgtatttcngtgcgagacgccaccagcaccgtggcttgacttggcggggccagggaccctggtccaccgtctcctcacgccctaccgaccgaacgggccccagtcccggtcccttcccccgnggccctcccgtcgccctccgaagggacgccacccgttccgagcgccacgcggccggcccgtgggcctcgaccgtggttcgaacgg

SEQ ID NO: 349914 - DNA, 547 bp, Homo sapiens
  misc_feature: GZ8MTXP01AS0C0.44.78.H01.1.454.CMB.2.raw
  modified_base (380)..(380): a, c, t, g, unknown or other
  misc_feature (380)..(380): n is a, c, g, or t
  modified_base (510)..(510): a, c, t, g, unknown or other
  misc_feature (510)..(510): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagtccaaggcagagttagtatgaccaggagcacctccccaggtacagtctacatggaactgagcagcctgagatctgaggaacacggccgtgtatttctgtgcgagacncccacagcacctggcttgacttggtcggggccagggaaccctggtccaccgggtctccctcacgccctccaccgaacgggccccagtcccggtccttcccccgtggcccgcccttggccttccgagggcncgcccttcgaagacgccaacgcgccgccgttgggccg

SEQ ID NO: 349915 - DNA, 524 bp, Homo sapiens
  misc_feature: GZ8MTXP01B5OYZ.44.78.H01.1.454.CMB.2.raw
  modified_base (264)..(264): a, c, t, g, unknown or other
  misc_feature (264)..(264): n is a, c, g, or t
  modified_base (297)..(297): a, c, t, g, unknown or other
  misc_feature (297)..(297): n is a, c, g, or t
  modified_base (517)..(517): a, c, t, g, unknown or other
  misc_feature (517)..(517): n is a, c, g, or t
tcagacagtatatacacgaccggtgctcgatttagtgtgagtagtttgggtttggggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctggggaaacttgagtgataattgcttctgtatcagcagagccaggccagccccctangctggtcatctttcaggataataagcggccctnagggatccctgagcgcttctctggctccaactcctgggaacacggccacgtctgccatcagcgcgaccagcctctggatgaggctgactattactgtcagacgtgggaaagtggcttaagttgggtgttcggcggagggaccaagctgaccgttcgtcggtcagcccaagggcctcgcccccttggttcacttctcgttccccaccctccttctaacttnttaaccg

SEQ ID NO: 349916 - DNA, 648 bp, Homo sapiens
  misc_feature: GZ8MTXP01D40X8.44.78.H01.1.454.CMB.2.raw
  modified_base (365)..(365): a, c, t, g, unknown or other
  misc_feature (365)..(365): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtcgtccccaggacacacagtcactattacctgctcgtaggggaaacttgagtgataaattgcttctggtatcagcagaggcaggccacgcccctatgctggtcatcttcagataataagcgcctcgagggactcccgtgacgcgcttctcctcggcctaccaactcgtaacggggaaccncgggcccaactcctacgacccatcgaacgcccgccgaacccacggccctcgtagggaacttggacgggtctaggaaccttagtttaaccgtggtaccgtaaggacgggttaagggaaagttggtacgttaaaggttcggggttaggtttcggggacggggtaacgggaacccgaaagggtcctgggaacccggtttcgttaccgggtaccgacggaccccggaacggttccgtccggcccccttcgggtccctacccgttcgttcccggtttccccgtccccc

SEQ ID NO: 349917 - DNA, 510 bp, Homo sapiens
  misc_feature: GZ8MTXP01B0Y93.44.78.H01.1.454.CMB.2.raw
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (472)..(472): a, c, t, g, unknown or other
  misc_feature (472)..(472): n is a, c, g, or t
  modified_base (488)..(488): a, c, t, g, unknown or other
  misc_feature (488)..(488): n is a, c, g, or t
  modified_base (495)..(495): a, c, t, g, unknown or other
  misc_feature (495)..(495): n is a, c, g, or t
tcagacagtatatacacgaccggtgctcgatttagtgtgagtagtttgggttgggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagtccaaggcagagtagtatgaccaggagcacctccccaggtacagtctacatggaactgagcagcctgagatctgaggaacacggccgtgtatttcngtgcganacgccaccagcactggcttgacttgtgggccaggaccctggtcaccggtctctcacgcctcaccaggcccatcggtctcccctgccgccttgcttaccgngcgccaccttccgaanacgcacngccgtcccgttgggc

SEQ ID NO: 349918 - DNA, 551 bp, Homo sapiens
  misc_feature: GZ8MTXP01EBB8H.44.78.H01.1.454.CMB.2.raw
  modified_base (371)..(371): a, c, t, g, unknown or other
  misc_feature (371)..(371): n is a, c, g, or t
  modified_base (387)..(387): a, c, t, g, unknown or other
  misc_feature (387)..(387): n is a, c, g, or t
  modified_base (490)..(490): a, c, t, g, unknown or other
  misc_feature (490)..(490): n is a, c, g, or t
  modified_base (510)..(510): a, c, t, g, unknown or other
  misc_feature (510)..(510): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaaacgacgggcttgcccagaagtccaaggcagagttagatgaccagagcacctcccaggtacagtctacatggaactgagcagcctagagatctgacggaacacggccgtgtatttcngtgcgagacgccacancactggcttgacttggcgggccacgggacctggtccaccgggttctcctcacgccctccaccgaacggccctagtcccggtcccttccccgtggcccgtcccncggccttccgacgggacccnccgaccgacgaacacgcgacgcggccggtcccgttcggtcg

SEQ ID NO: 349919 - DNA, 559 bp, Homo sapiens
  misc_feature: GZ8MTXP01B1RQ7.44.78.H01.1.454.CMB.2.raw
  modified_base (364)..(364): a, c, t, g, unknown or other
  misc_feature (364)..(364): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtaggggaaaacttgagtgattaaattgcttcctggtatcagcagaggccaggccacgccccctatgctggtcatctttcaggataataagcgccctcgagggctcctgacgcgtcttctcctggctccaactcgtaacgggaacnccggccacgtctcgaccatcacgccgccgacccacgccctcgtggaactggaacgctagactattaactgtacgagtacgtagggaaatcgagttaagtgggtagttcggcgggaggaccgaaggctcggttaccgttcgcggtacgcgaccgacggctcgcccccgtcggtccacttccgtcgttccccgtccc

SEQ ID NO: 349920 - DNA, 597 bp, Homo sapiens
  misc_feature: GZ8MTXP01CT10X.44.78.H01.1.454.CMB.2.raw
  modified_base (347)..(347): a, c, t, g, unknown or other
  misc_feature (347)..(347): n is a, c, g, or t
  modified_base (505)..(505): a, c, t, g, unknown or other
  misc_feature (505)..(505): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacgggctttgcccagaagttccaaggcagagtagtatgacaggagcacctcccaggtacagtctacatggaactgagcagcctgagatctgacgacacggccgtgtattcngtgcgagacgccacagcacctggcttgacttggtcggggacccagggtaacccctgggtccacccgtctccctacacgccctcccgaacccgaacgggcccctagttccccggtcccttcccccgtgggccctccccgttcgccctcccgaacgggcncccgtaacccgttccggaaacgcgacccgaccgacggcccgggaccccgttgggggcccttcgggccccgttgggttaacccgtaaaacggg

SEQ ID NO: 349921 - DNA, 589 bp, Homo sapiens
  misc_feature: GZ8MTXP01BRO4V.44.78.H01.1.454.CMB.2.raw
  modified_base (307)..(307): a, c, t, g, unknown or other
  misc_feature (307)..(307): n is a, c, g, or t
  modified_base (350)..(350): a, c, t, g, unknown or other
  misc_feature (350)..(350): n is a, c, g, or t
  modified_base (405)..(405): a, c, t, g, unknown or other
  misc_feature (405)..(405): n is a, c, g, or t
  modified_base (420)..(420): a, c, t, g, unknown or other
  misc_feature (420)..(420): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggattttcctgctgctatttaaaaggtgtccagtgtgaggtgcagttggtggagtcgtgggggaggtttggtaaagccgtggggagtcccttagactctcctgtgcagcctctggattcactttcagtaacgcctggatgacctgggtccnccaggctccgaggagggctggagtgggtgcgtatagacaagcngacggtggacagcagactaacgctgccaccgtgaaacgcagatcacatcacaganatagattacaaaagntacgtagtctcgtggacaggtatacgaacacgcctaaggaaaccgaccggaaggaccacgaacgtcccgttcttaacgttacgttggtccgtaggggttagttcgggtttacaacgggttccggggaacctaacgggggtaaccccttgggtaacccgaacccggttcc

SEQ ID NO: 349922 - DNA, 519 bp, Homo sapiens
  misc_feature: GZ8MTXP01DQN1Y.44.78.H01.1.454.CMB.2.raw
  modified_base (349)..(349): a, c, t, g, unknown or other
  misc_feature (349)..(349): n is a, c, g, or t
  modified_base (383)..(383): a, c, t, g, unknown or other
  misc_feature (383)..(383): n is a, c, g, or t
  modified_base (462)..(462): a, c, t, g, unknown or other
  misc_feature (462)..(462): n is a, c, g, or t
  modified_base (475)..(475): a, c, t, g, unknown or other
  misc_feature (475)..(475): n is a, c, g, or t
  modified_base (480)..(480): a, c, t, g, unknown or other
  misc_feature (480)..(480): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacgggcttgcccagaagtcccaaggcagagtagtatgaccaggagcacctcccaggtacagtctacatggaactgagcagcctgagatctgacggacacggccgtgtatttcngtgcgagacgccacagcacctggcttgacttggnggggccaaggggacccctgggtccaccgtctcctacacgcctccaccgaacgggccccagtcccggtctcccctggccncctgctccaagcncaccncgagncncncggccgccctgggcctgcctggttcaacgg

SEQ ID NO: 349923 - DNA, 585 bp, Homo sapiens
  misc_feature: GZ8MTXP01BV6TY.44.78.H01.1.454.CMB.2.raw
  modified_base (352)..(352): a, c, t, g, unknown or other
  misc_feature (352)..(352): n is a, c, g, or t
  modified_base (477)..(477): a, c, t, g, unknown or other
  misc_feature (477)..(477): n is a, c, g, or t
  modified_base (512)..(512): a, c, t, g, unknown or other
  misc_feature (512)..(512): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacgacgggctttgcccagaagttccaaggcagagtagtatgaccaggagcacctccccaggtacagtctacatggaactgagcagcctgagatctgacggacacggccgtgtatttcngtgcgagacgccacagcaccgtggcttggacgttggtcggggaccgaacggggaccctgggtccaccgtctcctcacgccctccgaaccgtaacgggcccctacgtcccggttcccttcccccgngggccccgtcccgtacgcccgtcccgaaggggccncccgacccgttccggacgcgccgacgcggcccgggcccgtggggcctcggcccgtcggttaaccgtaaacggg

SEQ ID NO: 349924 - DNA, 657 bp, Homo sapiens
  misc_feature: GZ8MTXP01AMCXN.44.78.H01.1.454.CMB.2.raw
  modified_base (370)..(370): a, c, t, g, unknown or other
  misc_feature (370)..(370): n is a, c, g, or t
  modified_base (587)..(587): a, c, t, g, unknown or other
  misc_feature (587)..(587): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagtccaaggcagagttagtatgaccaggagcacctccccaggtacagtctacatggaactgagcagcctgagatcgtgagaacacggccgtgtatttcngtgcgagacgccacgagcaccgtggcttagacgtttggtcggggcccgacggggtaacccctgggtacccaacccggggttcctcccgttccgaaccggtccccttacccgaacccgaaaccgggggtccccctaacgttccccggggtttccccttcccccccggttcgggccccgtcccccgttcggcccccgttacccggaaccgggggtaccnccccgaaccccgttcccgggaacggacgcccgaccgaccgggttccccgggccccgttcggggtccccgg

SEQ ID NO: 349925 - DNA, 841 bp, Homo sapiens
  misc_feature: GZ8MTXP01ET2NE.44.78.H01.1.454.CMB.2.raw
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggattttccttgctgctatttaaaaggtgtccagtgtgaggtgcagttggtggagtcgtgggggaggtttggtaaagccgtggggagtcccttagactctcctgtgcagcctctggattcactttcagtaacgcctggatgacagtcgggtccgccaggcctaccggagggggaagggggcgtagggaggttgggggttcgggaccgttaagttaacggaaacccgaaaaggcgttagggaacccggggtggggaacaggaccgaacggtaaaccctaaccggccgttacggacccgaaccccgggtaaggaaaacggggccgaaaggtaacctttacccgaaaccctaacttaccgtaacgaaaagggtacgtaaacgtttagggtaaactttaaaccgaaaaaaaggttaccgttaacggggttacggttaccctttaccggggttaggtaccgaaagggtaacgttaacggaaaacccgacggtaaccccgtaaacggaaaaccccgtaaacccgggaaacgggaaaccaacccgaaacggtccccggtttaacttaaacgttttaccgtagggttccggttacgggggttagttttcggggtttaaccctaacgggtttccccggggggaaccctaaccggggggttaaacccccttcgggggttaacccctaacccccgg

SEQ ID NO: 349926 - DNA, 553 bp, Homo sapiens
  misc_feature: GZ8MTXP01CNTZF.44.78.H01.1.454.CMB.2.raw
  modified_base (434)..(434): a, c, t, g, unknown or other
  misc_feature (434)..(434): n is a, c, g, or t
  modified_base (477)..(477): a, c, t, g, unknown or other
  misc_feature (477)..(477): n is a, c, g, or t
  modified_base (498)..(498): a, c, t, g, unknown or other
  misc_feature (498)..(498): n is a, c, g, or t
  modified_base (506)..(506): a, c, t, g, unknown or other
  misc_feature (506)..(506): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtgcaacgacgggcttgcccagaacgttccaaggcagagtagtatgaccaggagccacctccccaggtacagtctacataggaactgagcagcctgagatcgtaggacggacgacggtccgttagtactttcgtgtcgcgagacgccaccgagccaccgtggcttggacgttgggcgggaccagggacccctggtcccaccgttcncctcacgccgtccaacgacggcccagtcccgtcccttccccgnggcctcctgcctccgaaggcncctacccncgagcgccgacgcggccggcccgtgggcctcggccgtggcctaacgg

SEQ ID NO: 349927 - DNA, 579 bp, Homo sapiens
  misc_feature: GZ8MTXP01EMF5V.44.78.H01.1.454.CMB.2.raw
  modified_base (327)..(327): a, c, t, g, unknown or other
  misc_feature (327)..(327): n is a, c, g, or t
  modified_base (550)..(550): a, c, t, g, unknown or other
  misc_feature (550)..(550): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggacaacgacgggctttgccagaagtccaaggcagagttagtatgaccaggacgccacctccccgagtacagtctanatggaactgagcagctgagatcgtggaggaaccgacggtcgtgttactttcgtgtgcgagacgccacagccacgtggcttgacgttggtcgggccgacgggtacctggtccaccggtctccgtcacgccctacccgaaccgtaacgggcccctacgttcccgtcccttcccccgtgggcccctccccgttgcccttccgacggacgcccttaccgccgaagcnccgaacgcggcccgcccgttggggaaccc

SEQ ID NO: 349928 - DNA, 551 bp, Homo sapiens
  misc_feature: GZ8MTXP01D62QE.44.78.H01.1.454.CMB.2.raw
  modified_base (344)..(344): a, c, t, g, unknown or other
  misc_feature (344)..(344): n is a, c, g, or t
  modified_base (496)..(496): a, c, t, g, unknown or other
  misc_feature (496)..(496): n is a, c, g, or t
  modified_base (519)..(519): a, c, t, g, unknown or other
  misc_feature (519)..(519): n is a, c, g, or t
  modified_base (522)..(522): a, c, t, g, unknown or other
  misc_feature (522)..(522): n is a, c, g, or t
  modified_base (530)..(530): a, c, t, g, unknown or other
  misc_feature (530)..(530): n is a, c, g, or t
  modified_base (545)..(545): a, c, t, g, unknown or other
  misc_feature (545)..(545): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggctttgcccaagaagtccaaggcagagttagatgaccaggagcacctcccaggtacagtctacatggaactgagcagcctganatctgaggaacacggcgtgtattctgtgcgagacgccacagcaccgtggtcttgacgtttggcgggggacccaacggggaaccctgggtcccaccgggttcctccgttcacgtcccacccaccgaacggccctagtccggtcccttccccgnggcccgccttgccttcgagcgcnccncgaagacncacgcgccgtcccgngggtcc

SEQ ID NO: 349929 - DNA, 513 bp, Homo sapiens
  misc_feature: GZ8MTXP01BVYUW.44.78.H01.1.454.CMB.2.raw
  modified_base (304)..(304): a, c, t, g, unknown or other
  misc_feature (304)..(304): n is a, c, g, or t
  modified_base (316)..(316): a, c, t, g, unknown or other
  misc_feature (316)..(316): n is a, c, g, or t
  modified_base (319)..(319): a, c, t, g, unknown or other
  misc_feature (319)..(319): n is a, c, g, or t
  modified_base (346)..(346): a, c, t, g, unknown or other
  misc_feature (346)..(346): n is a, c, g, or t
  modified_base (366)..(366): a, c, t, g, unknown or other
  misc_feature (366)..(366): n is a, c, g, or t
  modified_base (386)..(386): a, c, t, g, unknown or other
  misc_feature (386)..(386): n is a, c, g, or t
tcagacagtatatacacgaccggtgctcgatttagtgtgagtagtttgggtttgggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctagggaaacttgagtgataattgcttctgtatcagcagaggccaggccagcccctatgctggtcatctttcagataataagcgcctnagggatcctgancgnttctcctggctccaactctagggaacncggccatctcgacatcagcncgaccagcctctgatgagcngactagtactgtcgagacggtaggaaagtgctaagttgggtagttcgggcggacggaccaaggctcgaccgttcgcggtcacgcccgagggcctcggcccctcggtccacgttctcgttcccaaccc

SEQ ID NO: 349930 - DNA, 539 bp, Homo sapiens
  misc_feature: GZ8MTXP01D1PKM.44.78.H01.1.454.CMB.2.raw
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtctggggcctcctctgacctgactcagccatcctcactgtccgtgtccccaggacacacagtcactattacctgctcgtaggggaaaacttgagtgataattgcttctgtatcagcagaggccaggccacgccccctatcgctggtcatctttcaggataataagcgcctcagggactcctgacgcgtcttcctctggctccaactcgtacggaacacggccactctcgacatcacgcgcgacccagcctcgtgatgaggctagactattactggtacgagacgtaggaaagtgacgtagttgggtgttcggcgggacggacgaagcgttgtaccgttcgtcggtcacggcccgaaggcctccgccccgttcggcaccttccgttaaccgttccccc

SEQ ID NO: 349931 - DNA, 650 bp, Homo sapiens
  misc_feature: GZ8MTXP01A82UR.44.78.H01.1.454.CMB.2.raw
  modified_base (271)..(271): a, c, t, g, unknown or other
  misc_feature (271)..(271): n is a, c, g, or t
tcagacagtatatacacgaccggtgctcgatttagtgtgagtagtttgggtttgggggaagcagcatcggaggtgcctcagccatggcatggatccctctcttcctcggcgtccttgcttactgcacagggtccggggcctcctctgacctgactcagccatcctcactgtccgtgtccccaggacacgcagtcactattacctgctcgtaggggaaaacttgagtgataaattgcttctggtatcagcagaggccaggccacgcccctangctggtcatcttcaggataataagcgcctgagggactccctgacgcgtcttcgtctcggctccaactccgtagggaacacggccactctcgaaccatccagccgccgacccagccctcgtggatggaggctagaacttattacgtgtacgagacggtagggaaagtgggtacgttaaggttggggtacggttacggggacgggaacggggacctaaagggtccgttacgggtaacccgttttcggccgggttaaccgaaccggttaccccgtaaacgggttcccgtcccgggtccccccgttcgggttcccttaacccgtttcccgttcccggtttcccccggtccccttccgttaccttaacgttaactttaacccgg

SEQ ID NO: 349932 - DNA, 609 bp, Homo sapiens
  misc_feature: GZ8MTXP01A7XAS.44.78.H01.1.454.CMB.2.raw
  modified_base (354)..(354): a, c, t, g, unknown or other
  misc_feature (354)..(354): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacgacgggctttgcccagaacgttccaaggcagagtagatgacaggacgcacctccccaggtacagtctacataggaactgagcagctgagatctgacggacgacggccgtgtatttcgngtgcgagacgccacgacgcacctggcttggacgttgggtcggggacctaacggggaaccccttgggtacccacccggttctacccgtacgaccggcccctacccgaacccggtaaccgggcccctacggttcccggttccccttcccccgtacggcccgtcccccgtgccctccgaaggaccgccaacccgttccgaagcgccacgttacggcccggtccgtcggggccttcgggcccgtgggttcgaaaccggg

SEQ ID NO: 349933 - DNA, 572 bp, Homo sapiens
  misc_feature: GZ8MTXP01BZSH2.44.78.H01.1.454.CMB.2.raw
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagtccaaggcagagttagtatgaccaggagcacctccccaggtacagtctacatggaactgagcagcctgagatctgaggaacacggccgtgtatttctgtgcgagacgccacagcacctggcttggacttggtcggggccagggaacccctggtccaccgggtctcctcacgccctccgaccgaacgggccccagttccgggttcccttcccccgtgggcccgtccccgttggcccttcccgaacgggacgccgacccgttcccggaagacgccaacgcggccggccccgttggggtcccg

SEQ ID NO: 349934 - DNA, 532 bp, Homo sapiens
  misc_feature: GZ8MTXP01C7GYO.44.78.H01.1.454.CMB.2.raw
  modified_base (385)..(385): a, c, t, g, unknown or other
  misc_feature (385)..(385): n is a, c, g, or t
  modified_base (514)..(514): a, c, t, g, unknown or other
  misc_feature (514)..(514): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacgggctttgcccagaagttccaaggcagagtagtatgaccaggagcacctccccaggtacagtctacatggaactgagcagcctgagatctgacggacacggcgtgtatttctgtgcgagacgccaccagcacctggcttgacttggngggccagggaccctggcaccgtctcctcacgccctcaccgaacgggcccagtccggtcctccccgtgcccgtccctgcctccgcggacgccaaccttcccgagacgccgacacggccgcccgtgggccnggccctgggttccaacgg

SEQ ID NO: 349935 - DNA, 685 bp, Homo sapiens
  misc_feature: GZ8MTXP01BTFDA.44.78.H01.1.454.CMB.2.raw
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaaacgacgggtcttcgacccagaacgtccgaaggcagagttagtatgaccaggacgccacctcccaggtacagtctacataggaactgacgcagcctagagattcgaggaacggaaaccgacggtccgtgttactttcgtgtgacggagacgcccacgacgccaccgtggtcttaggacgtttgggcggggacccgaacgggtaaccccgttgggtccccacccggggttcctacccgtcgaccggtccctacccgaaccgaaccgggtcccctaaccgttccccgggttccccttccccccggtcgggtccccgtcccccgttcggaccccgttcccggaaacgggtaccgacccccgttaccccggacccggaacgggaccggcccgaaacccgggaccgggttccccggggccccgttcgggggtccccg

SEQ ID NO: 349936 - DNA, 696 bp, Homo sapiens
  misc_feature: GZ8MTXP01BOWZL.44.78.H01.1.454.CMB.2.raw
  modified_base (351)..(351): a, c, t, g, unknown or other
  misc_feature (351)..(351): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacgggctttgcccagaagttccaaggcagagtagtatgaccaggagcacctccccaggtacagtcacataggaactgagcagcctgagatcgtgacggacacggcgtgtatttcnggtgcgagacgccacgagccaccgtggcttggacgttgggtcggggcccaacggggtacccctgggtacccacccggttcctcccgtacgaccggccccttacccgaacccggaaaccggggccccctaacggtttcccccggggttccccttttcccccccggcgggggtccccgtccccccgttgggccccgttaccccggaacgggggtacccaccccggtaaaccccgttcccgggaaacggtaaccggaccccgacggacccgggggccccgggggttcccccggttgggggccccgtttcgggacccccggtttggggttaaccccgtaaaacccgggg

SEQ ID NO: 349937 - DNA, 718 bp, Homo sapiens
  misc_feature: GZ8MTXP01BSS6A.44.78.H01.1.454.CMB.2.raw
tcagacagtatatacacgaccggtgctcgatttagtgtgagtagtttgggtttggggctgggcctcaggaagcagcatcggaggttcctcagccatggcatggatccctctcttcctcggcgtccttgcttactgcacgagggtccggggcctcctctgacctgactcagccatcctcactgtccgtgtccccaggacacacagtcactattacctgctcgtaggggaaaacttgagtagaattaaatttgacttctggtatcagcagacggccaggccacgcccctatcgctggtctattctttacgaggtaataaagtaacggccggcccttacgagggtacctcccgtggacgtccgtcttctcgtcggcctacgaaccttcggacgggaaacccaccgggccctaactccgtacgacccaatccgaacgcccgacccgaacccacggccctaccgttaggacgttacggacgggtctacggaaccttaacttaccgtagttaccgaaggggtaacgggttaaggggaaacgttcggacgtttaaagggttggggtacggtttaccggggacgggttaacggggaacgtaacggtcgtaaccgggtaaccgtttcggtaaccgggttcgaacccggtcccgaacgggttcccgttccccggcccccgttcggtaacctcccggtccgtttcccggtcccccttaacccgtttccc

SEQ ID NO: 349938 - DNA, 559 bp, Homo sapiens
  misc_feature: GZ8MTXP01BD8FF.44.78.H01.1.454.CMB.2.raw
  modified_base (522)..(522): a, c, t, g, unknown or other
  misc_feature (522)..(522): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacgacgggctttgcccagaagttccaaggcagagtagtatgaccaggagcacctccccaggtacagtctacatggaactgagcagcctgagatcgtgacggacacggccgtgtatttctgtgcgagacgccacagcaccgtgcttgacttggtcgggccaacgggaccctggtccacccgtctaccctcacgccctaccgaccgaaacgggccccagtccccggtccttcccccgtggcccgtccccgtcgcctcccgaagggcgcccaacccgttccgagcgccacncgtcccggccctgggcctcggccgtggttccaaccgg

SEQ ID NO: 349939 - DNA, 594 bp, Homo sapiens
  misc_feature: GZ8MTXP01DGCXD.44.78.H01.1.454.CMB.2.raw
  modified_base (387)..(387): a, c, t, g, unknown or other
  misc_feature (387)..(387): n is a, c, g, or t
  modified_base (530)..(530): a, c, t, g, unknown or other
  misc_feature (530)..(530): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacggcttgcccagaagtccaaggcagagtagtatgacaggagcacctcccagtacagtctacatggaactgagcagcctgagtatcgtgaggaacacgggtccgtgtatttcgtgtgacggagacgccacngcacgtgctgacttggcggggccacgggaccctgggtaccaccgggtctcctccacgccctccgaaccgaacgggcccctagtcccggtcccttccccccgtgggcccgtccccttcggcccttcccggaacggggaaccccncccgttacccgttccggaacgaccgcccgaaccggccgggccccggtcccggttcggggtcccg

SEQ ID NO: 349940 - DNA, 554 bp, Homo sapiens
  misc_feature: GZ8MTXP01CYAX3.44.78.H01.1.454.CMB.2.raw
  modified_base (467)..(467): a, c, t, g, unknown or other
  misc_feature (467)..(467): n is a, c, g, or t
  modified_base (492)..(492): a, c, t, g, unknown or other
  misc_feature (492)..(492): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagtagtatgaccaggagcaccctccccaggtacagtctacatggaactgagcagcctgagatctgacggacacggccgtgtatttctgtgcgagacgccaccagcaccgtggcttggacttggcggggccagggaccctggtccaccgtctcctcacgccctccgaaccgaacgggccccagtcccggtcccttcccccgnggccgtcccgtcgcctccgaaggcnccaccgttcgagcgaccgcgacggccggcccctggggccctggcccgttgggcctaaacggg

SEQ ID NO: 349941 - DNA, 536 bp, Homo sapiens
  misc_feature: GZ8MTXP01DT9BF.44.78.H01.1.454.CMB.2.raw
  modified_base (470)..(470): a, c, t, g, unknown or other
  misc_feature (470)..(470): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacggctttgcccagaagtccaaggcagagttagtatgaccaggagcacctcccaggtacagtctacagtggaactgagcagcctgagatctgaggaacacggccgtgtatttctgtgcgagcgccacagcactgcttgacttgtcgggcacgggaaccctggtccaccgggtctcctcacgcctccacacgggcccacgtccggtccttccccgnggtccgcccttcggccttccgaggcgcgccgttccgaagacgcacgacgccggcccgttgggtccg

SEQ ID NO: 349942 - DNA, 658 bp, Homo sapiens
  misc_feature: GZ8MTXP01AM50N.44.78.H01.1.454.CMB.2.raw
  modified_base (249)..(249): a, c, t, g, unknown or other
  misc_feature (249)..(249): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatatcaactgggtgcgacaggccactggacaagggcttggagtggatgggatggatcgaaccctaanagtggtaacacaggctatgcacagaagttccgagggcagacgtcaccatcgaaccaaggaaccaccctaccaataaaccacacgccctaacagtggagctggacgcagcctagagaatcgtgacggacgacgggtccgtagtattacgtgtcgacgagactacccggaaagtagtacgcgacgcgtcgggtcgggggtaggttcgggttcccggaccccggggtcggggacccggtacggggtaaccccgtgggtacccgtaccggtccctccgtccgtacgtcccgttacccgaacccggtaacggggccccttacggttcccggttccccgttcccccgtcgggccccgttccccgttcgcccgtccggaacggacgcccgttaccgtccgggttcgggggaacccg

SEQ ID NO: 349943 - DNA, 597 bp, Homo sapiens
  misc_feature: GZ8MTXP01EAS0A.44.78.H01.1.454.CMB.2.raw
  modified_base (264)..(264): a, c, t, g, unknown or other
  misc_feature (264)..(264): n is a, c, g, or t
  modified_base (316)..(316): a, c, t, g, unknown or other
  misc_feature (316)..(316): n is a, c, g, or t
  modified_base (382)..(382): a, c, t, g, unknown or other
  misc_feature (382)..(382): n is a, c, g, or t
tcagacagtatatacacgaccggtgctcgatttagtgtgagtagtttgggtttggggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctggggaaacttgagtgataaattgcttctgtatcagcagagccaggccagccccctangctggtcatctttcaggataataagcggcctcagggatccctgagcgcttcnctggctccaactcctaggggaacacggccacgtctgaacccatccagcgccgacccagcccttcgngatgaggctagtacttattacgtgtacgagtacggtagggaaagtcggtacgttaaggttcgggtggttcgggacgggaacggaccgaaggtccgtacgtaccgttcgtcggtccgacggacccgaacggttccgtcccggtccccgttccggttccttacccgttccgttacccgtttaaccccacccttccgttactaacgttaacgttaacg

SEQ ID NO: 349944 - DNA, 535 bp, Homo sapiens
  misc_feature: GZ8MTXP01BH4SS.44.78.H01.1.454.CMB.2.raw
  modified_base (321)..(321): a, c, t, g, unknown or other
  misc_feature (321)..(321): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
  modified_base (470)..(470): a, c, t, g, unknown or other
  misc_feature (470)..(470): n is a, c, g, or t
  modified_base (475)..(475): a, c, t, g, unknown or other
  misc_feature (475)..(475): n is a, c, g, or t
  modified_base (495)..(495): a, c, t, g, unknown or other
  misc_feature (495)..(495): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagtccaaggcagagttagatgaccaggagcacctcccagtacagtctanatggaactgagcagcctgagatctgacgaacacggccgtgtattctgtgcgagacnccacngcactggcttgacttggcgggccacgggaacctgggtccaccggtctcctcacgccctccaccgacggcccagtccggtccttccccnggccncccttgccttccgacggacnccgccttccgaagcgcacgcggcccggtccgttggggtcc

SEQ ID NO: 349945 - DNA, 552 bp, Homo sapiens
  misc_feature: GZ8MTXP01AGBTR.44.78.H01.1.454.CMB.2.raw
  modified_base (487)..(487): a, c, t, g, unknown or other
  misc_feature (487)..(487): n is a, c, g, or t
  modified_base (510)..(510): a, c, t, g, unknown or other
  misc_feature (510)..(510): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacggctttgcccagaagtccaaggcagagttagtatgaccaggagcacctccccagtacagtctacatggaactgagcagcctgagatctgaggaacacgggccgtgtatttctgtgcgagacgccacagcaccgtggcttgacttggtcggggccagggaacccctgggtccaccgggtctccctcacgccctccgaccgaacgggcccagtccggtcctccccgtggccncccttgccttccgacggacgccncccgttccgaagcgccaacgcgttccggcccgttggggtccc

SEQ ID NO: 349946 - DNA, 606 bp, Homo sapiens
  misc_feature: GZ8MTXP01AWN3Q.44.78.H01.1.454.CMB.2.raw
  modified_base (287)..(287): a, c, t, g, unknown or other
  misc_feature (287)..(287): n is a, c, g, or t
  modified_base (381)..(381): a, c, t, g, unknown or other
  misc_feature (381)..(381): n is a, c, g, or t
  modified_base (433)..(433): a, c, t, g, unknown or other
  misc_feature (433)..(433): n is a, c, g, or t
tcagacagtatatacacgaccggtgctcgatttagtgtgagtagtttgggtttggggcctgggcctcaggaagcagcatcggaggtgcctcagccatggcatggatccctctcttcctcggcgtccttgcttactgcacagggtccgggcctcctctgacctgactcagccatcctcactcgtccgtcgtccccaggacacacagtcactattacctgctcgtagggtaaaacttgagtgaattaattgcttcgtggtatcagcagacggccaggccacgcccctancgctggtcattcttacgagtaataagtagccgccctgagggactcccgtgacgccgtcttctccgtcggcctaccaactcgtaaagggaacccnccggccaacctctacgacccagtcacgccgcccgaacccgcgtcccgttcgnggacgtgacggctagacttattaccgtgtacgaggtacggtagggaaacgtgtacgttaaggttggggttcgttcgggacgggacggaaccgaaggtcgtcgttacccggttcttcgggtccacgccccgaggcctcccgccccgtgtccaccttctcccgttccctaacccc

SEQ ID NO: 349947 - DNA, 588 bp, Homo sapiens
  misc_feature: GZ8MTXP01D9RC4.44.78.H01.1.454.CMB.2.raw
  modified_base (309)..(309): a, c, t, g, unknown or other
  misc_feature (309)..(309): n is a, c, g, or t
  modified_base (328)..(328): a, c, t, g, unknown or other
  misc_feature (328)..(328): n is a, c, g, or t
  modified_base (353)..(353): a, c, t, g, unknown or other
  misc_feature (353)..(353): n is a, c, g, or t
  modified_base (484)..(484): a, c, t, g, unknown or other
  misc_feature (484)..(484): n is a, c, g, or t
  modified_base (540)..(540): a, c, t, g, unknown or other
  misc_feature (540)..(540): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacgacgggctttgacccaagaagttccaaggcagagtagtatgaccaggagccacctccccaggtacagtctacntaggaactgagcagctganatctgacgacacggcgtgtatttcngtgcgagacgccacagcacctggcttgacgttggtcggggacccacggggtaaccctgggtacccaccggttcctccgtacaccgccctccgaaccgaaccgggccccagttcccggtccctttcccccgngggccctccccgttgcccgtccgaacggcgcccacccgttccgagaaccgccgacncggcccgggccccttgggggccttcggcccgttcggttccgaaaccgg

SEQ ID NO: 349948 - DNA, 563 bp, Homo sapiens
  misc_feature: GZ8MTXP01BATX1.44.78.H01.1.454.CMB.2.raw
  modified_base (375)..(375): a, c, t, g, unknown or other
  misc_feature (375)..(375): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggtctttgcccagaagtccaaggcagagttagatgaccaggacgcacctccccagtacagtctacatggaactgagcagcctgagatcgtgaggaacacggtccgtagtatttcgngtcgcgagacgccacacgcaccgtgccttgacgttggcgggaccgagggaccctgggtccaccggtctccgtcacgccctccgaccgacggcccctacgtccggtcccttccccgtggcccctcccgttcgccttccgacggcgccgttcccgccgaagccgccgacgcgccggtcccgttgggcccg

SEQ ID NO: 349949 - DNA, 546 bp, Homo sapiens
  misc_feature: GZ8MTXP01B0FA1.44.78.H01.1.454.CMB.2.raw
  modified_base (334)..(334): a, c, t, g, unknown or other
  misc_feature (334)..(334): n is a, c, g, or t
  modified_base (376)..(376): a, c, t, g, unknown or other
  misc_feature (376)..(376): n is a, c, g, or t
  modified_base (527)..(527): a, c, t, g, unknown or other
  misc_feature (527)..(527): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagtccaaggcagagttagtatgaccaggagcacctccccaggtacagtctacatggaactgancagcctgagatctgaggacacggcgtgtatttctgtgcgagngccacagcactgcttgacttgtggggcacgggaaccctgggtccaccggggtctccctcacgccctccaccgaagggccccagtccggtcctttcccccggggcccgccccttgccttccgacgggacgccacccttccgaagacgcaacnggttccggcccttggggcc

SEQ ID NO: 349950 - DNA, 582 bp, Homo sapiens
  misc_feature: GZ8MTXP01BJEGR.44.78.H01.1.454.CMB.2.raw
  modified_base (361)..(361): a, c, t, g, unknown or other
  misc_feature (361)..(361): n is a, c, g, or t
  modified_base (399)..(399): a, c, t, g, unknown or other
  misc_feature (399)..(399): n is a, c, g, or t
tcagacagtatatacacgaccggtgctcgatttagtgtgagtagtttgggtttgggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctcgtggggaaacttgagtgataattgcttctgtatcagcagaggccaggccagccccctatgctggtcatctttcaggtataagtaagcggccctcgagggactcccgtgacgcgcttctcctggctccaactcgtacgggaacncggccacgtctcgaccatcacgcgcgacccagcctcgnggactgaggctgactatactgtcgaggacgtgggaaagtgtcgtaagttggggtagttcgggcgggtagggacccgtaaggctcggttacccgttcgttcgggtaccgacggccccgaacgggttcccgtccggccccccgttcgggtccctaccgttcccgtccggtttccccctaaccccg

SEQ ID NO: 349951 - DNA, 588 bp, Homo sapiens
  misc_feature: GZ8MTXP01A29T0.44.78.H01.1.454.CMB.2.raw
  modified_base (538)..(538): a, c, t, g, unknown or other
  misc_feature (538)..(538): n is a, c, g, or t
  modified_base (554)..(554): a, c, t, g, unknown or other
  misc_feature (554)..(554): n is a, c, g, or t
  modified_base (574)..(574): a, c, t, g, unknown or other
  misc_feature (574)..(574): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtgcaacgacgggtctttcgcccagaagttccgaaggcagagtagtatgaccaggacgccaccctcccaggtacagtctacataggaactgacgcacgcctagagatcgtaggacggacacggtccgtgttactttctgtgcgagacgccaccgacgcaccgtgcttggacgttgggtccggggacctaacggggtacccttggtacccgacccgttcctccctacgaccgcccgtacccgaaccgtaaccgggcccctagtcccggtccccttccccgcgggccctccccgtgcccgtcgaacgggccncgacccttccgaagcncgacgcgccgccgtgggccncggcctggctaacg

SEQ ID NO: 349952 - DNA, 541 bp, Homo sapiens
  misc_feature: GZ8MTXP01A6UJ8.44.78.H01.1.454.CMB.2.raw
  modified_base (369)..(369): a, c, t, g, unknown or other
  misc_feature (369)..(369): n is a, c, g, or t
  modified_base (483)..(483): a, c, t, g, unknown or other
  misc_feature (483)..(483): n is a, c, g, or t
  modified_base (502)..(502): a, c, t, g, unknown or other
  misc_feature (502)..(502): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacggctttgcccagaagtccaaggcagagttagatgaccaggagcacctccccaggtacagtctacatggaactgagcagcctgagatctgaggaacacgggccgtgtatttcngtgcgagacgccacagcacctggcttgacttgtggggccagggaccctgggtccaccgggtctcctcacgccctccgaccgaagggccccagtccggtccttcccccgtggccncccttgccttccgaggacnccgccttccgaagcgccacacggccggcccgttggggcc

SEQ ID NO: 349953 - DNA, 669 bp, Homo sapiens
  misc_feature: GZ8MTXP01AYCES.44.78.H01.1.454.CMB.2.raw
  modified_base (355)..(355): a, c, t, g, unknown or other
  misc_feature (355)..(355): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtgcaacgacgggtcttgcccagaagttccaaggcagagtagatgaccaggagccacctcccaggtaccagtctacatggaactgagcagcctagagatctggacggacacgggtcgtgtatttcgngtggcgagacgcccaccgagacctaccgtggctttaggacgtttcgggacgggggaccctaacgggggtaccccttgggtaccctaccccggttcctcccgttaccgacggacccctacccgaaccccggtaaccggggccccctaacgttccccgggtccccctttcccccgcggggcccctcccccgttggcccctcccggaacggcccgcccgtaaccccgccgggaaacgtacgacccgaaccggccgggccccgggttccccgcggggtccctccgggcccgtttaacgggggaacctaaaccccgggg

SEQ ID NO: 349954 - DNA, 565 bp, Homo sapiens
  misc_feature: GZ8MTXP01DL9Q2.44.78.H01.1.454.CMB.2.raw
  modified_base (488)..(488): a, c, t, g, unknown or other
  misc_feature (488)..(488): n is a, c, g, or t
  modified_base (528)..(528): a, c, t, g, unknown or other
  misc_feature (528)..(528): n is a, c, g, or t
  modified_base (534)..(534): a, c, t, g, unknown or other
  misc_feature (534)..(534): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggctttgcccagaagttccaaggcagagtagtatgaccaggagccacctccccaggtacagtctacataggaactgagcagcctgagatctgacggacacggcgtgtatttcgtgtgcgagacgccaccagcaccgtggtcttgacgttggtcggggacccaaggggtaaccccttgggtccaccgttcctccgtccaccgcctacccgaaccgtaacgggcccctagttcccggtcccttccccgnggccctccctgccctccgaaggcgcctaacccgcgaggcnccgacncggcgcccgtgggctcggccttggcctaacg

SEQ ID NO: 349955 - DNA, 562 bp, Homo sapiens
  misc_feature: GZ8MTXP01A2F02.44.78.H01.1.454.CMB.2.raw
  modified_base (379)..(379): a, c, t, g, unknown or other
  misc_feature (379)..(379): n is a, c, g, or t
  modified_base (487)..(487): a, c, t, g, unknown or other
  misc_feature (487)..(487): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacggctttgcccagaagtccaaggcagagttagtatgaccaggagcacctccccaggtacagtctacatggaactgagcagcctgagatcgtgagacacggcctgtatttctgtgcgagacnccacagcaccgtggcttgacgttggtcggggaccagggaccctggtccaccgggtctctcacgccctccgaccgaacgggccctacgtcccgggtccctttcccccgngggcccgcccttggcccttccgacggacgcccttaccgccgaagcgccaacgcggccggccccgttggggtcccg

SEQ ID NO: 349956 - DNA, 593 bp, Homo sapiens
  misc_feature: GZ8MTXP01CVMW6.44.78.H01.1.454.CMB.2.raw
  modified_base (502)..(502): a, c, t, g, unknown or other
  misc_feature (502)..(502): n is a, c, g, or t
  modified_base (530)..(530): a, c, t, g, unknown or other
  misc_feature (530)..(530): n is a, c, g, or t
  modified_base (554)..(554): a, c, t, g, unknown or other
  misc_feature (554)..(554): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtgcaacgacgggtcttgcccaagaacgttccaaggcagagtagtatgaccaggacgccaccctcccgaggtacagtactacatggaactgagcacgcctagagatctaggacggacgacggtccgtagttactttctgtgacgagacgcccacagcaccgtgtccttgacgttgggacgggacccaaggggtaccccttgggacccaccgttctccctacgaccgccctacccgaaccgtaaccgggcccctagttcccggtccttccccgngggccctccctgccctccgaagggtccnccacccgcgaaagcacgttaccgngggccccgccgtgggccttcggccgttggaaccgtaacg

SEQ ID NO: 349957 - DNA, 575 bp, Homo sapiens
  misc_feature: GZ8MTXP01ELXI0.44.78.H01.1.454.CMB.2.raw
  modified_base (350)..(350): a, c, t, g, unknown or other
  misc_feature (350)..(350): n is a, c, g, or t
  modified_base (469)..(469): a, c, t, g, unknown or other
  misc_feature (469)..(469): n is a, c, g, or t
  modified_base (536)..(536): a, c, t, g, unknown or other
  misc_feature (536)..(536): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacggctttgcccagaagtccaaggcagagttagtatgaccaggacgccaccctcccaggtacagtctacagtaggaactgaagctagcctgagntcgtgaacggaaccacgggtccgttagtactttcgtgtgacggagacgcccacagcctaccgtgcttgacgttggtcggggccgtacgggaccctgggtacccaccgggtcctcctacncgccctcccaccgaacggcctacgtcccgtccttccccgcgccgtcccttgccttccgaaggcgccnccgttcgaacgacgcgacgcggccggtccgttgggtccg

SEQ ID NO: 349958 - DNA, 591 bp, Homo sapiens
  misc_feature: GZ8MTXP01AWWUQ.44.78.H01.1.454.CMB.2.raw
  modified_base (304)..(304): a, c, t, g, unknown or other
  misc_feature (304)..(304): n is a, c, g, or t
tcagacagtatatacacgaccggtgctcgatttagtgtgagtagtttgggtttgggggggtctcaggaggcagcgctctcaggacgtcaccaccatggcctgggctctgctcctcctcaccctcctcactcagggcacaggatcctgggctcagtctgccctggctcagcctccctccgtgcccgggtctcctggacagtcagtcaccatctcctgcactggaaccaacagtgacgtcggtcgttttgaccgtgtctctggtaccagcacgaccccagaaaccacgaccccaaatcattattangcgtcaatcgttccgcccttcggtcgtccctgacgcgtcttcgtcgtcgggtaccccaagtctacggaccaaacgacccggtccctcccgtagaccctatcgtcgttcgggccttaccgaggtctaggacggacgaggtctagtatttagttactgacagtctacataactaacgaagtacggtaaactacgtttactagttcggcgtcgaacggaccaagctacgaccgtcgttaggtcacgcccgagcctccgcccctcggtccacgttcctcgttccccgtccc

SEQ ID NO: 349959 - DNA, 592 bp, Homo sapiens
  misc_feature: GZ8MTXP01A0S03.44.78.H01.1.454.CMB.2.raw
  modified_base (373)..(373): a, c, t, g, unknown or other
  misc_feature (373)..(373): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacgagggtccggggcctcctctgacctgactcagccatcctcactgtccgtgtccccaggacacacagtcactattacctgctcgtaggggaaacttgagtgataattgcttctgtatcagcagaggccaggccacgccccctatcgctggtcatctttcaggataagtaacgcggccctcgagggactcccgtgacgcgtcttctccgtggcctaccaactcgtaacggggaaccnccggccactctcgaccatcacgccgaccgacccacgcctcgtggactgagctgactattactgtacgaggtacggtagggaaagtgtacgttaaggttggggtacggttcgggacggggaacgggtaccgaaggtcgtacggttaccggttcgttccgggtacgacgacccgaggccgtccgccccgtcggtccaccgttccgtccgttcccctaaccc

SEQ ID NO: 349960 - DNA, 546 bp, Homo sapiens
  misc_feature: GZ8MTXP01CZZKY.44.78.H01.1.454.CMB.2.raw
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtgcaacacgggcttgcccagaagttccaaggcagagtagtatgaccaggagccacctccccaggtacagtctacatggaactgagcagcctgagatctgacggacacggccgtgtatttctgtgcgagacgccaccagcaccgtggcttggacttggcggggcccaaggggacccctggtccaccgtctcctcacgcctcccaccgaacgggccccagtcccggtcccttccccgtggccctccctgcctcccgaagggcgccacccttcgacgcgccgacgcggtccggccctgggcctggccctggttcaacgg

SEQ ID NO: 349961 - DNA, 608 bp, Homo sapiens
  misc_feature: GZ8MTXP01D9EJK.44.78.H01.1.454.CMB.2.raw
  modified_base (371)..(371): a, c, t, g, unknown or other
  misc_feature (371)..(371): n is a, c, g, or t
  modified_base (409)..(409): a, c, t, g, unknown or other
  misc_feature (409)..(409): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacgaggggtccgggcctcctctgacctgactcagccatcctcactgtccgtcgtccccaggacacacagtcactattacctgctcgtagggaaacttgagtgataattgcttctggtatcagcagaggccaggccacgcccctatcgctggtcatctttacgaggtataataagccgccctgacgggtactcccgtgacgcgtcttctcgtcggctaccaactcgtaacggaacncggccactctcgaccatcacgccgcgacccagcctcgnggatgagtctagactaattacgtgtcggaaggtacggtagggtaaagtgtacgttaagttggggtacggttcggggacgggtaggaccgaaggtccgttaggttacccgttcgttaccgggtacaccggacccgaggttcccgtaacccggtccccctcgggttccacccgttccgttccccgttccccgtaacccccg

SEQ ID NO: 349962 - DNA, 591 bp, Homo sapiens
  misc_feature: GZ8MTXP01DF79W.44.78.H01.1.454.CMB.2.raw
  modified_base (184)..(184): a, c, t, g, unknown or other
  misc_feature (184)..(184): n is a, c, g, or t
  modified_base (436)..(436): a, c, t, g, unknown or other
  misc_feature (436)..(436): n is a, c, g, or t
  modified_base (460)..(460): a, c, t, g, unknown or other
  misc_feature (460)..(460): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggattttcctgctgctattttaaaaggngtccagtgtgaggtgcagttggtggagtcgtgggggaggtttggtaaagccgtggggatcccttagactctcctgtgcagcctctggattcactttcagtaacgctggatgaccgtgggtccgcaggcctcgagggagggctggagtgggtgcgtatagacaagctgacggtggacagcagactaacgctgcacccgtgaaacggcagactacaccatcacaagagatagaattacaaaagtctaacgggtntactcgtggacaagagtacgaacncgaccgtacgaaaccgacgaacgaccacgacgtaaccgttacttaattacgttgttacggtaggttacgtttcggttacgtaacggttccgggaaccgtaacgggtacccgttcggtaacccgttccgtcc

SEQ ID NO: 349963 - DNA, 556 bp, Homo sapiens
  misc_feature: GZ8MTXP01BBDWM.44.78.H01.1.454.CMB.2.raw
  modified_base (352)..(352): a, c, t, g, unknown or other
  misc_feature (352)..(352): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctcgtaggggaaacttgagtgataattgcttctgtatcagcagaggcaggccagcccctatgctggtcatcttcaggataataagcgcctgagggactcctgagcgcttctctggctccaactcgtaacgggaacncggccactctgaccatcgacgccgacgacccagccctgtcggattcggaggtctgacttattacgtgtcgaaggtacggtagggaaagtgacgttaagttggggtaggttcgggacgggtacgggaccgaaggccgtaggcccggttcgttcggtcacgcccgaggcctcggcccctcggtccacttccgtcgttccccgtccc

SEQ ID NO: 349964 - DNA, 608 bp, Homo sapiens
  misc_feature: GZ8MTXP01BOSHB.44.78.H01.1.454.CMB.2.raw
  modified_base (376)..(376): a, c, t, g, unknown or other
  misc_feature (376)..(376): n is a, c, g, or t
  modified_base (513)..(513): a, c, t, g, unknown or other
  misc_feature (513)..(513): n is a, c, g, or t
  modified_base (579)..(579): a, c, t, g, unknown or other
  misc_feature (579)..(579): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctagtagtggacaacgacgggtctttggcccaagaacgttccgaaggcaggtagtagtatcgaaccgaggacgccacccgtccccgaggtacagtctacataggaactgagcagccgtgagatcgtagacggacacggtccgtgttatttcgngtgcgagacgcccacagcaccgtgtcttgacgttgggtcggggacccaacggggtaacccttgggtcccaccggttcctcctcgaccggcccctaccgaaccgtacgggcccctacgtcccgggttcccttccccgngggcccctcccgttcgcctcccggaaggaccgccacccgttcgagcgccgacgccggccggcccgngggcctcggttcctcgggttaaccaacgg

SEQ ID NO: 349965 - DNA, 534 bp, Homo sapiens
  misc_feature: GZ8MTXP01BOHZ5.44.78.H01.1.454.CMB.2.raw
  modified_base (473)..(473): a, c, t, g, unknown or other
  misc_feature (473)..(473): n is a, c, g, or t
tcagacagtatatacacgaccggtgctcgatttagtgtgagtagtttgggtttgggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctggggaaacttgagtgataaattgcttcctggtatcagcagaggccaggccagccccctatgctggtcatctttcaggataataagcgcctcagggatccctgagcgcttcgtcctggctccaactctagggaacaacggccactctgaccatcagccgcacccgtagcctctggatcgaggctgactattactgtcgagacgtgggaaagtgctaagtgggtagttcggcggagggaccaaggcttaaccgttntcggttcagtcccaagggccttacggccccctgggtccactcttcgttccccaaccctccc

SEQ ID NO: 349966 - DNA, 515 bp, Homo sapiens
  misc_feature: GZ8MTXP01EUABK.44.78.H01.1.454.CMB.2.raw
  modified_base (365)..(365): a, c, t, g, unknown or other
  misc_feature (365)..(365): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (459)..(459): a, c, t, g, unknown or other
  misc_feature (459)..(459): n is a, c, g, or t
  modified_base (477)..(477): a, c, t, g, unknown or other
  misc_feature (477)..(477): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgagcctatagtggcaacacgggctttgcccagaagtccaaggcagagttagtatgacaggagcacctccccagtacagtcacatggaactgagcagcctgagatctgaggaacacggccgtgtatttcngtgcgagacgccacagcaccgtgcttgacttgtgggcaggacctgtcacggtctcctcncncctccaccgacggcccatccgtctccccgtgcncccttgccttccgacgcnccgccttccgaagacgcacgagttccgccgttcgggcc

SEQ ID NO: 349967 - DNA, 700 bp, Homo sapiens
  misc_feature: GZ8MTXP01B8TC1.44.78.H01.1.454.CMB.2.raw
  modified_base (370)..(370): a, c, t, g, unknown or other
  misc_feature (370)..(370): n is a, c, g, or t
  modified_base (399)..(399): a, c, t, g, unknown or other
  misc_feature (399)..(399): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtaggggaaacttgagtgaataattgcttctgtatcagcagagcaggccagcccctatgctggtcattcttcaggataataacgccggccctcgagggtactccgtagacgtcgtctttcctccgtcggctccgaactcgtaacgggaaccnccggcctaactctacgacctatcacgccnccgacccacgccctcgtggactggacggtctacggaacttacttaacgtcgttacggaacggtaccgggttaaggggaaagttcggtaaccgtttaaagggtttcgggggttacgggtttcccggggaacggggtaaccgggggtaaccctaaacgggtccgttacccggttaacccgggtttccgttacccgggtacgtaaccggacccccggttaagggttcccttcccccgggtcccccccgtaaggggttcccctaccccgtttccgttccccggggttttcccccgttcccccccg

SEQ ID NO: 349968 - DNA, 682 bp, Homo sapiens
  misc_feature: GZ8MTXP01BLQSS.44.78.H01.1.454.CMB.2.raw
  modified_base (309)..(309): a, c, t, g, unknown or other
  misc_feature (309)..(309): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggctttgcccagaacgttccaaggcagagtagtatgaccaggacgcaccctccccaggtacagtctanatggaactgagcagcctgagatctgacggaccacggccgtgttactttcgtgtgacgagacgacccaaccgacgcacccgtggtccttaggtacgttcggggtcgggggacccgtaacgggggtaaccccttcgggttaccgaccccggttctccccgtacaacccggtccctacccgaacccggaaaccggggcccctaacgttccccgggttccccttcccccggtcgggccccgtcccccgttcgggcccttccccgggaagggaccgcccgaaaccccgttccgggaaacgtccggaccccacggaccgggccccggggccccgtggggcccgttccgggaccccggtttgggttaacccgtaaaccgg

SEQ ID NO: 349969 - DNA, 557 bp, Homo sapiens
  misc_feature: GZ8MTXP01B07NK.44.78.H01.1.454.CMB.2.raw
  modified_base (367)..(367): a, c, t, g, unknown or other
  misc_feature (367)..(367): n is a, c, g, or t
  modified_base (550)..(550): a, c, t, g, unknown or other
  misc_feature (550)..(550): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacggcttgcccagaagtccaaggcagagttagtatgacaggagcacctccccaggtacagtctacatggaactgagcagcctgagatcgtgagaacacggccgtgtatttcngtgcgagagccacagcaccgtggcttgacttggtcggggccaggggaaccctgggtaccaccgggtctccgtcacgcctccaccgaacgggcccctagtcccgggtcccttccccccgtgggcccgccccgttggccttccgacggacgccaccgttccgaagacgcacgagttccggcccgnggggtcc

SEQ ID NO: 349970 - DNA, 745 bp, Homo sapiens
  misc_feature: GZ8MTXP01B1FDW.44.78.H01.1.454.CMB.2.raw
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacgacgggctttgcccagaacgttccaaggcagagtagtatgaccaggagcaccctcccaggtacagtctacataggaactgagcagcctgaagatcgtaggaacggaccgacgggtcccgttagttactttccgtggtgacgtaaggacgccccaaccgacgacctacccgtgggtcttacggtacgttcggggtacgggggacccgtaacgggggtaaccccttcgggtacccacccggttcctacccgttacacccggtccccttaccccgaacccggaaaccgggggtccccctaacggttccccgggttcccccgtttccccccggtcggggcccccgtcccccgttcggccccgttacccggaaacgggcccgaccccgtaaaccccgttcccgggaaaggtacccggaccccgaaaccggaccccggggtccccggggtcccccggtttcgggggcccgtcccgggttacccggtttcgggggttaacccgtaaaaacccgggg

SEQ ID NO: 349971 - DNA, 700 bp, Homo sapiens
  misc_feature: GZ8MTXP01DZPJ7.44.78.H01.1.454.CMB.2.raw
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaaacacggcttgccagaagtcaaggcagagttagtatgacaggagcacctcccgaggtacagtctacataggactgagcagcctagagatcgtggacggaaccgacgggtccgtgttaacgtttcgtggtacgcggaacgacgcccaacgacggcctaaccgttgggtacctttacggtaccggtttgggtccggggggaccccgtaaacggggggtaacccccttggggtacccctaacccggggttcccttcccgtcccaaccgggtcccctacccgaacccgtaacggggccccctaggttccccgggttcccctttccccggcggggtccctccccgttgggccccttacccggaaaggggtccaccccgttaacccggttacccggaagggaaaccgcccgaaaccgcggggttccccgggtcccgttcgggggtaaccccg

SEQ ID NO: 349972 - DNA, 552 bp, Homo sapiens
  misc_feature: GZ8MTXP01B180Z.44.78.H01.1.454.CMB.2.raw
  modified_base (490)..(490): a, c, t, g, unknown or other
  misc_feature (490)..(490): n is a, c, g, or t
  modified_base (506)..(506): a, c, t, g, unknown or other
  misc_feature (506)..(506): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggctttgcccagaagtccaaggcagagtagtatgaccaggagcacctcccagtacagtctacatggaactgagcagcctgagatcgtgaggaaccacggccgtgtatttctgtgcgagacgccacagcactggcttgacgttggcgggccagggaacccctggtccaccggtctcctcacgccctccgaccgaacgggcccacgtccggtcctccccgtggcccgtcccncggccttccgagggcnccgcccgttccgaagccgcacgcggcccggtcccgttggggtcccg

SEQ ID NO: 349973 - DNA, 617 bp, Homo sapiens
  misc_feature: GZ8MTXP01EGDQT.44.78.H01.1.454.CMB.2.raw
  modified_base (267)..(267): a, c, t, g, unknown or other
  misc_feature (267)..(267): n is a, c, g, or t
tcagacagtatatacacgaccggtgctcgatttagtgtgagtagtttgggtttgggggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctggggaaaacttgagtgataaattgcttctgtatcagcagaggccaggccagcccctangctggtcatcttcaggataataagcggccctcaggggactccctgacgcgtcttctcgtcggctaccactccgtacggaacacggccactctcgccatcgacgccgaccgacccgacgtccctcgtcggatggagtcgtagtaacttattacgtgtacgacggtacggtaggggtaaagtcggggtaacgtttaagggttggggttacgggttacgggacggggacgggtaaccgaaggtccgtcggtaccgttcgtccgggtaacacggcccgaaggttccgtcccgtccccgttcggttccttaccgttcgttccgtccccgtccctccttactaacttaacgttccg

SEQ ID NO: 349974 - DNA, 585 bp, Homo sapiens
  misc_feature: GZ8MTXP01EJ9I9.44.78.H01.1.454.CMB.2.raw
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (336)..(336): a, c, t, g, unknown or other
  misc_feature (336)..(336): n is a, c, g, or t
  modified_base (348)..(348): a, c, t, g, unknown or other
  misc_feature (348)..(348): n is a, c, g, or t
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
  modified_base (385)..(385): a, c, t, g, unknown or other
  misc_feature (385)..(385): n is a, c, g, or t
  modified_base (502)..(502): a, c, t, g, unknown or other
  misc_feature (502)..(502): n is a, c, g, or t
  modified_base (537)..(537): a, c, t, g, unknown or other
  misc_feature (537)..(537): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacggcttgcccaagaagtccaaggcagagttagtatgaccagganccaccnccccaggtcagtctacatggaactgagcngcctgagatcgngaggaacacggccgttgtattcngtgcgnacgccacngcacgtggctagaccgttgtcggggccacgggaaccctgggtcccaccgggttctacccgtcaacggtcccctacccgaccgaaacgggcccctagttcccggtccctttcccccgngggcccgtccccttggcccttccgacggggacccncccgacccgccggaagccgccgaccggtccggccgcccggttcggccg

SEQ ID NO: 349975 - DNA, 678 bp, Homo sapiens
  misc_feature: GZ8MTXP01BZUOD.44.78.H01.1.454.CMB.2.raw
  modified_base (273)..(273): a, c, t, g, unknown or other
  misc_feature (273)..(273): n is a, c, g, or t
tcagacagtatatacacgaccggtgctcgatttagtgtgagtagtttgggtttgggggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtaggggaaacttgagtagaattaaattgcttctggtatcagcagacgccacggccacgcccctancgctcggtcattcttacgaggtaataagtaacggccggacccctagacgggtactccccgtaggacgcgtcttctcgtcggcctaccaacgtccgtacggggaacaccggccctaacgtcctacgaaccacgtaccgacgcccgacccgaacccgacgtcccctggtacggagtcggacggtccttaggtaacttacgttaacgtcggtacgaacggtacggtaaggggtaaagttcgggtaacgtttaagggtttcggggtacgggttaccgggcgggtaacgggaccaacggtcgtacgggtaccgttcggtcggtcgaccggacccgtacggttcccgtcccgtccccgttcgttcccttaccttcgtccccgttccctcccttcttacctaagttaactcg

SEQ ID NO: 349976 - DNA, 563 bp, Homo sapiens
  misc_feature: GZ8MTXP01B3SW0.44.78.H01.1.454.CMB.2.raw
  modified_base (378)..(378): a, c, t, g, unknown or other
  misc_feature (378)..(378): n is a, c, g, or t
  modified_base (495)..(495): a, c, t, g, unknown or other
  misc_feature (495)..(495): n is a, c, g, or t
  modified_base (518)..(518): a, c, t, g, unknown or other
  misc_feature (518)..(518): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggctttgcccagaagtccaaggcagagttagtatgaccaggagccacctccccaggtacagtctacatggaactgagcagcctgagatcgtggaggaacacgggccgtgttatttcgngtgcgagacgccacagcaccgtggcttgacgttggtcggggaccacgggaaccctggtccaccgggtctccgtcacgccctaccaccgaacggcccctagtcccggtccttccccgnggcccgcccttgcttccgaggcnccgccgttccgaagcgccgacgacggttccggccgttcgggtccg

SEQ ID NO: 349977 - DNA, 645 bp, Homo sapiens
  misc_feature: GZ8MTXP01B15QX.44.78.H01.1.454.CMB.2.raw
  modified_base (369)..(369): a, c, t, g, unknown or other
  misc_feature (369)..(369): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacgacgggtctttgcccagaagttccaaggcagagtatatgaccaggacgcacctccccgaggtacagtctacatggaactgagcagcctagagtatcgtaggacggaccgacggtccgttagttacttttccgnggttcgacggaacgacgcccaaccgagccacccgtggtcttggtacgttgggtacggggacccgaacggggtaaccccttgggtacccgtaccggttcctcccgtacgaccgtcccctacccgaacccggaacgggcccctacgttccccgggttcccttccccggtcggtcccgtccccttcggccctccgaacggggccttacccgacccgttccggacgacgccgacgcgggcccggcccgtgggccctcggcccgttcggaaccgtaaccgg

SEQ ID NO: 349978 - DNA, 688 bp, Homo sapiens
  misc_feature: GZ8MTXP01AZBSF.44.78.H01.1.454.CMB.2.raw
  modified_base (343)..(343): a, c, t, g, unknown or other
  misc_feature (343)..(343): n is a, c, g, or t
  modified_base (380)..(380): a, c, t, g, unknown or other
  misc_feature (380)..(380): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaacgtgggtgcgacaggccgctggacaagggctggagtggatgggatggatgaagccctatagtggcaacgacggctttgcccagaagtccaaggcagagttagtatgacaggagcacctcccaggtacagtctacatggaactgagcagcctganatcgtggacggaacgacgggtccgtagttactttcgnggtcgacggagacgcccaaccgaggccaaccgttggtacgtttacggtaccggtttggggtaccgggggaccgaaccgggggtaaccccttcggggttaccccaacccgggggttcccttcccgttacccgaccggtccccttaccccgaacccggtaaccggggtaccccctacgttccccggttccccgtttccccccggcgggtccccgtccccgttcggtccccttcccggaacgggtaccgccccgacccgttaccgggaacgacgcccgaacgcgggccccggtccccggttggggtccccg

SEQ ID NO: 349979 - DNA, 537 bp, Homo sapiens
  misc_feature: GZ8MTXP01BBAJS.44.78.H01.1.454.CMB.2.raw
  modified_base (340)..(340): a, c, t, g, unknown or other
  misc_feature (340)..(340): n is a, c, g, or t
  modified_base (501)..(501): a, c, t, g, unknown or other
  misc_feature (501)..(501): n is a, c, g, or t
  modified_base (517)..(517): a, c, t, g, unknown or other
  misc_feature (517)..(517): n is a, c, g, or t
  modified_base (522)..(522): a, c, t, g, unknown or other
  misc_feature (522)..(522): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagtccaaggcagagttagtatgacagagcacctccccaggtacagtctacatggaactgagcagctganatcgtgaggaacacggcgtgtatttctgtgcgagacgccacagcaccgtgcttgacttggtcgggccagggaccctgggtccaccggtctccgtcacgccctccgaccgaacgggcccagtccggtccttcccccgtggcccgcccttgccttccgaggcnccgaccgttcgaagcnccacncgccgcccgttggcc

SEQ ID NO: 349980 - DNA, 650 bp, Homo sapiens
  misc_feature: GZ8MTXP01D2XAD.44.78.H01.1.454.CMB.2.raw
  modified_base (335)..(335): a, c, t, g, unknown or other
  misc_feature (335)..(335): n is a, c, g, or t
  modified_base (556)..(556): a, c, t, g, unknown or other
  misc_feature (556)..(556): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtgcaacgacggtcttgcccagaacgtccaaggcagagttagtatgaccaggagcacctcccaggtacagtctacagtggaactgancagcctgagatcgtaggacggaacacggtccgtgttactttcgtgtcgacggtagacgacccacgagccacgtggtcttacggtacgttgggtcggggacccgtaacggggaaccccgttgggtaccccgtaacccggggttccttacccgttccaccggtcccctacccgaacccggtaacggggcccctacgtccccgggtttccctttcccccccggngggtccccgcccgttcggtcccttccggaacgggtacgaccccgacccgttacccggaagacgccaaccgcggcccgggtcccgttgggtcccg

SEQ ID NO: 349981 - DNA, 637 bp, Homo sapiens
  misc_feature: GZ8MTXP01B6D6P.44.78.H01.1.454.CMB.2.raw
  modified_base (559)..(559): a, c, t, g, unknown or other
  misc_feature (559)..(559): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtgcaacgacgggcttgccagaagttccaaggcagagtagtatcgacgaggacgccacccgtccccaggtacagtctacagtaggaactgagcagcctgagtatcgtagaccggaccgacggtccgttgttactttcgtggtgcgagacgcccaccgacgcctaccgtggtacttcggacgttcgggtacggggacccgtaacggggtaccccttgggtaccctacccggtcctcccgtacgaccgtcccctaccgaaccggaaccgggcccctacgttccccggttccccttccccgtgggcccctcccgtcgtccctccggaaggtccncccaaccgttccggaaagccggacaccgcgggtcccggccccgtgggccctcgggccgtaacgggttaacgtaaaccg

SEQ ID NO: 349982 - DNA, 694 bp, Homo sapiens
  misc_feature: GZ8MTXP01EPS17.44.78.H01.1.454.CMB.2.raw
  modified_base (274)..(274): a, c, t, g, unknown or other
  misc_feature (274)..(274): n is a, c, g, or t
tcagacagtatatacacgaccggtgctcgatttagtgtgagtagtttgggtttgggggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtaggggaaaacttgagtgaattaaatttgcttctggtatcagcagaggccaggccacgccccctancgctggtcatcttcaggataataagccgcctcgagggactcccgtgacgcgctttctcgtcggcctccaaactccgtacgggaaacacggccaacgtctacgaaccatcacgccgaccgacccacgccctcgtggatggacggtctagtaacttagttactcggtaccgaaggtaacggtaaggggtaaacgttcggggtaacgtttaaagggtttcgggggttacgggtttaccggggacgggaacggggtaaccgaaacgggtccgttaacgggtaacccgtttccggtaccgggttaaccgaaccggccccggtaaacgggttcccgtaaccccgggtccccccgttcgggttcccttaccgttcccgttcccgttccccctaaccccttccttaccttaacgtttaaccttaaccg

SEQ ID NO: 349983 - DNA, 594 bp, Homo sapiens
  misc_feature: GZ8MTXP01DZMR6.44.78.H01.1.454.CMB.2.raw
  modified_base (506)..(506): a, c, t, g, unknown or other
  misc_feature (506)..(506): n is a, c, g, or t
  modified_base (534)..(534): a, c, t, g, unknown or other
  misc_feature (534)..(534): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtgcaacgacgggtcttgccccagaagttccaaggcaagagtagtatgaccgaaggacgccaccctcccgaggtacagtctacatggaactgagcagcctgagatcgtgacggacgacggtcgtgttacttcgtgtgcgagacgcccacgagcaccgtggactttggacgttggggtccggggacccaacggggtaccccttgggtacccaccgttcctcccgtacaccgtcccctacccgaaccgaaccgggcccctagtcccggtcccttccccgnggccctccctagcctccgaagggtcccncccgaccgcgacgcgccgcgccggcccggtccgtgggcctcgccgtaacggaacgtaacg

SEQ ID NO: 349984 - DNA, 573 bp, Homo sapiens
  misc_feature: GZ8MTXP01BOD58.44.78.H01.1.454.CMB.2.raw
  modified_base (440)..(440): a, c, t, g, unknown or other
  misc_feature (440)..(440): n is a, c, g, or t
  modified_base (469)..(469): a, c, t, g, unknown or other
  misc_feature (469)..(469): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacgcctggatgaccgtgggtcccgccgaggcctccgagggaagggctggagtgggtgccgtatagaaccaaagctgacggtggacagcagactaacgctcgcacccgtagaaacggcagacttcaccatctacaagagatagattacaaaagntaacggtgtctctgggactagatagaacngcctagaaccacgagacacgacgccgtacttattacgttgtcgtgggttagttggtttcaacgttcgggaaccgacgggaacccgttcggtccaaccgttcccg

SEQ ID NO: 349985 - DNA, 620 bp, Homo sapiens
  misc_feature: GZ8MTXP01CBVP9.44.78.H01.1.454.CMB.2.raw
  modified_base (553)..(553): a, c, t, g, unknown or other
  misc_feature (553)..(553): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagtccaaggcagagtagatgaccaggagcacctccccaggtacagtctacatggaactgagcagcctagagatcgtgaggaaccacgggtccgtgttaactttcgtggtgacgagacgcccaaccgagccacgtggcttagacgtttggcggggaccagggaacccctgggtacctaccgggtcctccgtccgacgtcccctcccgaaccgaacgggcccctagttcccggtcccttcccccgtgggccccgtccccgttcggccccttccgaacgggaccncccgttaccccgttccggaagaaccgccgaaacccggcgggccccgggtccccgttgggggtccccg

SEQ ID NO: 349986 - DNA, 530 bp, Homo sapiens
  misc_feature: GZ8MTXP01BW6HO.44.78.H01.1.454.CMB.2.raw
  modified_base (315)..(315): a, c, t, g, unknown or other
  misc_feature (315)..(315): n is a, c, g, or t
  modified_base (359)..(359): a, c, t, g, unknown or other
  misc_feature (359)..(359): n is a, c, g, or t
  modified_base (394)..(394): a, c, t, g, unknown or other
  misc_feature (394)..(394): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctggggaaaacttgagtgataaatttgcttcctggtatcagcagaggccaggccagccccctatgctggtcatctttcaggataataagcggccctnagggatccctgagcgcttctcctggctccaactcgtagggaacncggccactctgaccatcagcgcgacccagcctcgnggactgaggctagactattactgtcgaggacgtgggaaagtgcgtaagttgggtagttcggcggtagggaccaagcgtgaccgttcncggtcncgttcccgaggcctcgcccctggtcacgttctcgttccctccc

SEQ ID NO: 349987 - DNA, 522 bp, Homo sapiens
  misc_feature: GZ8MTXP01AFR53.44.78.H01.1.454.CMB.2.raw
  modified_base (236)..(236): a, c, t, g, unknown or other
  misc_feature (236)..(236): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
  modified_base (452)..(452): a, c, t, g, unknown or other
  misc_feature (452)..(452): n is a, c, g, or t
  modified_base (475)..(475): a, c, t, g, unknown or other
  misc_feature (475)..(475): n is a, c, g, or t
  modified_base (503)..(503): a, c, t, g, unknown or other
  misc_feature (503)..(503): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtgcaacncgggcttgcccagaagttccaaggcagagtagtatgaccaggagccacctccccaggtacagtcacatggaactgagcagcctgagatctgacggacacggcgtgtatttcngtgcgagagccacngcaccgtggcttgacttggcggggccagggaccctggtccaccgtctcctcgacgccctacaccgacggccccagtccgtccttccccgngccctcctcgccctcgaacggcnccgaccgcgacgcgcgcgcggccgccgnggctcgcgtcggaacgaag

SEQ ID NO: 349988 - DNA, 625 bp, Homo sapiens
  misc_feature: GZ8MTXP01CTJV6.44.78.H01.1.454.CMB.2.raw
  modified_base (285)..(285): a, c, t, g, unknown or other
  misc_feature (285)..(285): n is a, c, g, or t
  modified_base (382)..(382): a, c, t, g, unknown or other
  misc_feature (382)..(382): n is a, c, g, or t
  modified_base (567)..(567): a, c, t, g, unknown or other
  misc_feature (567)..(567): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacgaggggtccgggcctcctctgacctgactcagccatcctcactgtccgtgtccccaggacacacagtcactattacctgctacgtagggaaacttgagtgtaattaattgcttctggtatcagcagaggccaggccacgccccctancgtctggtctatctttacaggtaataataacggcggcccctagacgggactcccgtagacgcgtcttctccgtcggcctcactcgtaacgggaaccnccggcctactcgtacgacccagtccacgccgccgaccccagcctacgaggagtcggagtcgtagtaaccttaattacgtcgtacggaacggtacgggtagggtaaacgttgtacgtaaggtttggggtacgttcggggtaacgggacggaccgaaggtcgtacggttaccggttcgcgggtaacncgttacccgaggttcccgtaaccgccccgtcgtcctacttccttcgttcccctaaccc

SEQ ID NO: 349989 - DNA, 638 bp, Homo sapiens
  misc_feature: GZ8MTXP01DNA8A.44.78.H01.1.454.CMB.2.raw
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacgacgggctttgcccagaagttccaaggcagagtagtatgacaggagcacctccccaggtacagtctacataggaactgagcagcctgagatcgtggaaccggacgacggtccgttgttatttcgtggtgcgagacgccacagcaccgtgtcttgacgttgggcgggacccaacgggggtacccctgggtacccaccggttcctcccgtacaccgccctacccgaaccgtaacgggcccctaacgttccccggttcccttccccggtcgggtccctccccgttcggccctcccggaaacgggccgttacccgaaccccgttacggaacgtcggacccaccggacgggtccccggtaccgtcgggggtcctccgggaccccgttggggttaaccctaaaccggg

SEQ ID NO: 349990 - DNA, 691 bp, Homo sapiens
  misc_feature: GZ8MTXP01DD9R5.44.78.H01.1.454.CMB.2.raw
  modified_base (302)..(302): a, c, t, g, unknown or other
  misc_feature (302)..(302): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggctttgcccagaagtccaaggcagagttagtatgacaggancacctccccaggtacagtactacagtggaactgagcagcctgagatcgtagacggaacacggccgtagttatttcgtgtgacgagacgaccacgagccaccgtggtaccttgtacgtttgggtacgggggaccgaacggggtaaccccttacgggtccccgtaaccggggttccccttacccgttaccgacccggtaccccttaccccgaaccccggaaaccgggccccctaacgttccccgggttccccgtttcccccccggtcgggtccccgtccccgttcggtccccgttacccggtaacgggaccgttaccccgaccccgttacccggaaacggacccggaaccgacccggaccgggccccgggtccccggttcgggtcccccgg

SEQ ID NO: 349991 - DNA, 799 bp, Homo sapiens
  misc_feature: GZ8MTXP01BB626.44.78.H01.1.454.CMB.2.raw
  modified_base (277)..(277): a, c, t, g, unknown or other
  misc_feature (277)..(277): n is a, c, g, or t
  modified_base (301)..(301): a, c, t, g, unknown or other
  misc_feature (301)..(301): n is a, c, g, or t
tcagacagtatatacacgaccggtgctcgatttagtgtgagtagtttgggtttgggggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctcgtaggggaaaacttgagtgaattaaatttgcttcctggtatcagcagacggccacggccacgcccctangctggtcattcttacaggtataanaggccggcctacgagggactcccgtgacgtccgtctttcgtcgttcggcctaccaacgttcccggtacggggaaaccacccgggtccctaccgtacctacgaacctaactaccgacggcccgacccgaaccccgaggtacccctggtggaacgtacggacgggtacttacgtaaacctttaagtttacccgtaggtaccgagggtaacgggttaaggggtaaaggtttcggggtaacggtttaaaggggtttcgggggttacggggtttaccgggggaacgggggaaaccggggtaaccgtaaacggggttcccgtaacgggggttaaccccgtttccgggtaacccggggttaaccggtaacccgggaccccggtaaacgggttccccggtaaccccggtccccccggttacgggttccccttacccgtttccccggtttccccggttccccccggtccccctttaccgtttaccttaaacgttccgtttaacccgg

SEQ ID NO: 349992 - DNA, 640 bp, Homo sapiens
  misc_feature: GZ8MTXP01BWSDI.44.78.H01.1.454.CMB.2.raw
  modified_base (282)..(282): a, c, t, g, unknown or other
  misc_feature (282)..(282): n is a, c, g, or t
tcagacagtatatacacgaccggtgctcgatttagtgtgagtagtttgggtttggggctgggtctcaggaagcagcatcggaggtgcctcagccatggcatggatccctctcttcctcggcgtccttgcttactgcacgagggtccgggcctcctctgacctgactcagccatcctcactcgtccgtcgtccccaggacacacagtcactatacctgctcgtagggaaacttgagtgattaattgcttcgtgtatcagcagacgcacggccacgccccctangctggtctattcgtttacgaaggtaataaacgtaacggccggcccctacgaacgggtactccccgtaggacgtccgtcttcctccgtcggcctacccgtaaaccgtcgtaaacgggaacccaaccggcctaaccttcgacgacccactcgacgccgaccgacccacgcctcgtggactggacgtcgtacgactattacgtgtacggaggtacgggtaggaaacgtgtacgttaaggttggggtcggtcggtacggggaggaccgaaggtcgtacgttacggtcgttcggtacgacgttccgaacggttccgtaaccgccccgttcgtaccgtccgttccgtcccgttcccctaacccc

SEQ ID NO: 349993 - DNA, 623 bp, Homo sapiens
  misc_feature: GZ8MTXP01C3P5L.44.78.H01.1.454.CMB.2.raw
  modified_base (297)..(297): a, c, t, g, unknown or other
  misc_feature (297)..(297): n is a, c, g, or t
  modified_base (367)..(367): a, c, t, g, unknown or other
  misc_feature (367)..(367): n is a, c, g, or t
  modified_base (393)..(393): a, c, t, g, unknown or other
  misc_feature (393)..(393): n is a, c, g, or t
tcagacagtatatacacgaccggtgctcgatttagtgtgagtagtttgggtttgggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactatacctgctcgtaggggaaactgagtgataaattgcttctggtatcagcagaggccaggccagcccctatcgctggtcatcttcagataanagcgcctgagggtactccgtgacgcgtctttctcgtacggtcctacgtaaccgtcgtaacggggaaaccnccgggcctaacctcgtacgaccctanacgacgccgaccgacccctacgcctccgtaggacgttgggacgtacgtacgtaccttagttactggttacgaacggtacgggtagggtaaagtcgtaagttaaggttggggtacgttcgggacgggtacggactaaggtccgtaggttaccgtttcgcggtaccgacgacccgttacgcccgtcccggtccccgtcgggtacctcccgttcctccgggttccccgtcccg

SEQ ID NO: 349994 - DNA, 553 bp, Homo sapiens
  misc_feature: GZ8MTXP01DIU99.44.78.H01.1.454.CMB.2.raw
  modified_base (369)..(369): a, c, t, g, unknown or other
  misc_feature (369)..(369): n is a, c, g, or t
  modified_base (377)..(377): a, c, t, g, unknown or other
  misc_feature (377)..(377): n is a, c, g, or t
  modified_base (511)..(511): a, c, t, g, unknown or other
  misc_feature (511)..(511): n is a, c, g, or t
tcagacagtatatacacgaccggtgctcgatttagtgtgagtagtttgggtttggggaagaggaagactgacggtcccactcccaggtacagctggtgcagtctggggctgaggtgaaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagtccaaggcagagttagtatgaccaggagcacctccccaggtacagtctacatggaactgagcagcctgagatctgaggaacacggcgtgtatttcngtgcgagngccacagcacctggcttgacttggacgggccagggaaccctggtccaccggggtctacctcacgccctccgaccgaagggccccatcccgggtccttcccccgtggcctccccgttgccttcccgaaggcgccncccttccggaagacgccaacgcgccggtcccgttgggggccg

SEQ ID NO: 349995 - DNA, 644 bp, Homo sapiens
  misc_feature: GZ8MTXP01AIOMJ.44.78.H01.1.454.CMB.2.raw
  modified_base (402)..(402): a, c, t, g, unknown or other
  misc_feature (402)..(402): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtctggggcctcctctgacctgactcagccatcctcactcgtccgtgtccccaggacacacagtcactattacctgctcgtaggggaaaacttgagtgaattaatttgcttctgtatcagcagaggccaggccacgccccctatcgcgtggtctattctttcgaaggtactaagtaaggccggtccctgaacgggtactccctggacgcgtcttcctcgtggcctacctaactcgtacgggaacaccggccactctcgacntacagccgccgtacccgagtccctgtacggacgtcggacggcttagtaacttagttacgtacggtcggaaggtaccggtaaggggtaaagtcggtacgttaaaggtttcgggggttacggttccggggcgggtaacggggaccaaagggcgttacggtaccggttcgtccgggttacgccggcccgttaacggcccgtccgtcccccgttcgggtacccttcgttcccttcggtttcccccc

SEQ ID NO: 349996 - DNA, 647 bp, Homo sapiens
  misc_feature: GZ8MTXP01B3XEN.44.78.H01.1.454.CMB.2.raw
  modified_base (236)..(236): a, c, t, g, unknown or other
  misc_feature (236)..(236): n is a, c, g, or t
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (326)..(326): a, c, t, g, unknown or other
  misc_feature (326)..(326): n is a, c, g, or t
  modified_base (329)..(329): a, c, t, g, unknown or other
  misc_feature (329)..(329): n is a, c, g, or t
  modified_base (353)..(353): a, c, t, g, unknown or other
  misc_feature (353)..(353): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtgcaacncgggctttgcccagaagttccaaggcagtagtagtatgaccaggngccacctccccaggtacngtctacatggaactgagcagcctgagntcngacggacgacggccgtgtatttcngtgcgagacgccaccagccaccgtgcttggacgttgggacggggccgaacggggtaacccctgggtacccacccgtctccctacacgccccttacccgaaccggaaccggggtccccctacggttccccggtcccgtttccccccggtggtccccgtccccgtcggtcccgtcccgaagggtacccgccgtaaccccgttccgggaacggaccgccgaacccggcgggccccgggtccccggtcgggggtcctccgggttcccggttaacggggttaacccgtaaaacccgggg

SEQ ID NO: 349997 - DNA, 562 bp, Homo sapiens
  misc_feature: GZ8MTXP01EGXTI.44.78.H01.1.454.CMB.2.raw
  modified_base (323)..(323): a, c, t, g, unknown or other
  misc_feature (323)..(323): n is a, c, g, or t
  modified_base (506)..(506): a, c, t, g, unknown or other
  misc_feature (506)..(506): n is a, c, g, or t
  modified_base (526)..(526): a, c, t, g, unknown or other
  misc_feature (526)..(526): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacgacgggcttgcccagaagtccaaggcagagttagtatgacaggagcaccctcccgaggtacagtctanatggaactgagcagcctgagatcgtagacggaacacggccgtgttattcgtgtgcgagcgccacgagcaccgtggtcttagtacgttgggtcggggccgaacgggaacccgtggtaccgaccgggttctcccgtcaccgccctaccgaccgaacgggccctagtcccgtcctccccgtgcccncccttagccttcgacggacnccgccgttcgaagcgctacgcgccgccgttcggccg

SEQ ID NO: 349998 - DNA, 546 bp, Homo sapiens
  misc_feature: GZ8MTXP01COOZ8.44.78.H01.1.454.CMB.2.raw
  modified_base (350)..(350): a, c, t, g, unknown or other
  misc_feature (350)..(350): n is a, c, g, or t
  modified_base (459)..(459): a, c, t, g, unknown or other
  misc_feature (459)..(459): n is a, c, g, or t
  modified_base (485)..(485): a, c, t, g, unknown or other
  misc_feature (485)..(485): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtgcaacacgggcttgcccagaacgttccaaggcagagtagatgaccaggagcacctccccaggtacagtctacatggaactgagcagcctgagatctggacggacacggcgtgtactttcngtgcgagacgcccacagcactggcttgacttggcgggccagggtaaccctggaccaccgtctcctcacgccctaccaccgaagggcccctagtccggtcccttccccgnggccgtccctgcctccgaagggcccncctacccgcggacgcgacgcgcgcccggccgtcgggcctcggccgtcggttaaccgaacgg

SEQ ID NO: 349999 - DNA, 700 bp, Homo sapiens
  misc_feature: GZ8MTXP01DH05A.44.78.H01.1.454.CMB.2.raw
  modified_base (396)..(396): a, c, t, g, unknown or other
  misc_feature (396)..(396): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacgagggtccggggcctcctctgacctgactcagccatcctcactgtccgtgtccccaggacacacagtcactattacctgctcgtagggaaaacttgagtgaataaatttgcttctggtatcagcagaggccaggccacgcccctatcgctggtcattctttacaaggtaataaacgtaacgccggtaccctacgacggggtactcccgtaggactccgtctttctcccgtggcctacctaacgtcgtaacgggaaccnccggcctacgttccacgacctacgtacacggccgacccgacccgacgtcctcgtggtaagtcggacggtacgtagtaaccttaagttacgtacggttcggaaacggtaacggggttaagggtaaaagtcggtaacgttagggtttagggggttcgggttaccggggtacgggaacgggtaccaaggtccgttacggttacccggtttccgttaccggtaccgacggttaccccgaacgggttcccgtccccgtacccccgttccgggtacctcccgttcccgttcccgtttccccctaaccccg

SEQ ID NO: 350000 - DNA, 555 bp, Homo sapiens
  misc_feature: GZ8MTXP01EPC6G.44.78.H01.1.454.CMB.2.raw
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatggatggatgaagcctatagtggcaaacacgggcttgcccagaagtccaaaggcgaagagtagtagtacgaccgacggacgaccacccctaccccgaacgtacgtacgtactaactagtaggaacgtagacgcaacgcctgacgatctagacggcgacggccgtgtatttcgtgtgcgagagccaccacgcactgcttgacttgtcgggccgagggaaccctcggggtcaccgtctcctcacgcctccaccaacggcccacgtccgtccttcccctcgccgcccttcgccgtccacgcgcgaacctccgaacgacgcgacgcgcggccg

SEQ ID NO: 350001 - DNA, 714 bp, Homo sapiens
  misc_feature: GZ8MTXP01D86JO.44.78.H01.1.454.CMB.2.raw
  modified_base (199)..(199): a, c, t, g, unknown or other
  misc_feature (199)..(199): n is a, c, g, or t
  modified_base (320)..(320): a, c, t, g, unknown or other
  misc_feature (320)..(320): n is a, c, g, or t
  modified_base (344)..(344): a, c, t, g, unknown or other
  misc_feature (344)..(344): n is a, c, g, or t
  modified_base (650)..(650): a, c, t, g, unknown or other
  misc_feature (650)..(650): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaatttatgattattaacgtgggtncgacaggccgcgtggacaagggctggagtggagtgggatggatgaacgcctagtagtggaccaaacgacgggtctttcgacccaagaacgtccgaaggcagtaagttagatgaccaggacnccaccctcccgaggtacagtctanagtaggaactgacgcacgctagagtatcgtaggacggaaccgacgggtccgttagttactttcgtgtgacgagacgacccacgcgacctacgttggtcgtttaggtacggttggggtaccgggggaccgtaaaccgggggtaacccttcggggttacccctaacccgggttcccgttcccgtaccgacccggtaccccttacccgaaacccggtaccggggtaccccttacggttccccgggttccccctttcccccgggcgggtccccgtccccgttcggccccgttaccggaccggggtaaccncccgttaccccgacgggaacgacgcccgaaccggccgggttcccgggtcccggttggggtcccg

SEQ ID NO: 350002 - DNA, 769 bp, Homo sapiens
  misc_feature: GZ8MTXP01BTFYL.44.78.H01.1.454.CMB.2.raw
  modified_base (266)..(266): a, c, t, g, unknown or other
  misc_feature (266)..(266): n is a, c, g, or t
  modified_base (584)..(584): a, c, t, g, unknown or other
  misc_feature (584)..(584): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggtattttccttgctgcttattttaaaaggtgtccagtgtgaggtgcagttggtggagtcgtgggggtagttggaagcgtggggactcctagactctctgtgcagcctcnggtattcactttcagtaacgctggatcgaccgtcgggccgccgaggcctaccggaaggggaacgggggctagggggtagggttgggggtttacggacccgtttaagttaacggaaacccaaaggtcgtagggaccgggtagggacaggacgaagacctaacggctcgggacctaaacccggggtagaaacggctaacggtacttaccaaccgtatctaacgaaaggtaagaagttacggtaaatttaaacgaaaaggtacgttaaccgggttacgtaccttacgtacgggaacttaaggggaacttaacggaaaaccnccggtaacccgtaacggaaaacccggaaacccggtaacgggaaccctaaccgaaccggttaacccgttacgttaaacgtttacgttcggttacggttggggttaacgttttcgggttacctaacgggtttccccgggaaccggttaccgggtaaccccgttcgggtcccttaaccccggtttccc

SEQ ID NO: 350003 - DNA, 634 bp, Homo sapiens
  misc_feature: GZ8MTXP01BJ6NQ.44.78.H01.1.454.CMB.2.raw
  modified_base (322)..(322): a, c, t, g, unknown or other
  misc_feature (322)..(322): n is a, c, g, or t
  modified_base (358)..(358): a, c, t, g, unknown or other
  misc_feature (358)..(358): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtaggggaaacttgagtgataaattgcttcctggtatcagcagaggccaggccacgccccctatgctggtcatcttcaggataagtagcgcctcagggatcccngagcgcttctcctcggctccaactcgtaacgggacncggcctacgtctcgaccactcgacgccgaccgacccgagcctcgtggactggaggctagacctattacgtcgtacgacggtaacggtaggggtaaacgtcggtacgttaaaggtttcgggggttaggtttccggggacggggtacgggtacccgaaaggtccgttcgggttacccggttcggttacggtacccgaacgggccccgttaaacgggccgttcccggccccccgttaacgggtcctaccgttcccgtccggtttcccccgtaacccccg

SEQ ID NO: 350004 - DNA, 545 bp, Homo sapiens
  misc_feature: GZ8MTXP01ADAF2.44.78.H01.1.454.CMB.2.raw
  modified_base (353)..(353): a, c, t, g, unknown or other
  misc_feature (353)..(353): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacgacgggctttgcccagaagttccaaggcagagtagtatgaccaggagcacctccccaggtacagtctacatggaactgagcagcctgagatcgtgacggacacggccgtgtatttcngtgcgagacgccaccagcacctggtcttgacttggtcgggacccagggtaccctggtccacccgttctcctcgacgccctccgaaccgaacgggccccactccggtcctccccgtgcccgtccctgcctcgaacgacacccgtcgacgcgcacgcgttccgccgtggctcgccgttgggtccaaggtaaccc

SEQ ID NO: 350005 - DNA, 608 bp, Homo sapiens
  misc_feature: GZ8MTXP01CEGMG.44.78.H01.1.454.CMB.2.raw
  modified_base (391)..(391): a, c, t, g, unknown or other
  misc_feature (391)..(391): n is a, c, g, or t
  modified_base (527)..(527): a, c, t, g, unknown or other
  misc_feature (527)..(527): n is a, c, g, or t
  modified_base (558)..(558): a, c, t, g, unknown or other
  misc_feature (558)..(558): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaacgtgggtgcgacaggccgcgtggacaagggctggagtggatgggatggatgaacgccctatagtggcaacgacgggcttgccagaagtccaaggcagagttagtatgaccaggacgcacccgtccccgaggtacagtactacagtaggactgacgcagcctagagatcgtggacggaaccacgggtccgtagttatttccgngtcgacgagacgcccacgacgccacgtggcttaggaccgtttggcgggggacctacggggtaaccctggtacccaccggttctaccctcgaacgcccctccgaaccgacgggcccctagtcccgtccgttccccgnggcccgtcccgttgcccgttccgagggtccncccgttaccttcggaacgcggcaaccggcgcccgggcccgttggggcccg

SEQ ID NO: 350006 - DNA, 749 bp, Homo sapiens
  misc_feature: GZ8MTXP01BO4PE.44.78.H01.1.454.CMB.2.raw
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaacgcctagtagtgcaacgacgggtcttgcccagaacgttccaaggcagtagtagatgacaggacgccacctccccgaggtacagtctacagtaggaactgacgcagcctagagatcgtagacggacgacggtcgtagttactttcgtgtcggacgtaagaccgacccaaccgacggccctaacccgttgggtaccctttagggtaaccggtttgggggtacccgggggaacccgtaaaccgggggtaacccctttcggggtaacccctaccccggtttccctacccgtacccgtacccggtaccccgttaacccgaaaccccggggtaaaccggggcccccttaacggtttcccccgggtttccccgtttccccccggtggggcccccgtccccgttgtaccccgtacccggaacgggtaccgccccgtaaacccggttccggaaacgccgacccgaccggttaccgggcccccgggtacccgttcgggggcccttccgggacccggttcggttaacccgtaaaccggg

SEQ ID NO: 350007 - DNA, 622 bp, Homo sapiens
  misc_feature: GZ8MTXP01DTT9X.44.78.H01.1.454.CMB.2.raw
  modified_base (326)..(326): a, c, t, g, unknown or other
  misc_feature (326)..(326): n is a, c, g, or t
  modified_base (344)..(344): a, c, t, g, unknown or other
  misc_feature (344)..(344): n is a, c, g, or t
  modified_base (377)..(377): a, c, t, g, unknown or other
  misc_feature (377)..(377): n is a, c, g, or t
  modified_base (564)..(564): a, c, t, g, unknown or other
  misc_feature (564)..(564): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaatttatgatattaactgggtgcgacaggccgctggacaagggctggagtggatgggatggatgaagccctatagtggcaacgacgggtctttgcccaagagtccaaggcagagttagtatgacaggagcacctcccgagtacagtctacntgactgagcagcctaganatcgtgaggaaccacgggccgttgtactttcgngtcgacgagacgcccaccgagccaccgtggtcgttcgtacgttgggtcggggccgtacgggaaccccgttggtccctaccggggttccttcccgtccaccgtccctccccgaccgtaaccgggcccctacgttccccggtcccttccccccgcgggcccctcccgttcgcccgttccgacgggtacncccgttacccgttccggaacggcgccaaccgccggcccgggtcccgttcgggtccccg

SEQ ID NO: 350008 - DNA, 608 bp, Homo sapiens
  misc_feature: GZ8MTXP01CQ38Q.44.78.H01.1.454.CMB.2.raw
  modified_base (298)..(298): a, c, t, g, unknown or other
  misc_feature (298)..(298): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacggcttgcccagaagtccaaggcagagttagatgacaggancacctccccaggtacagtctacatggaactgagcagccgtgagatcgtgaggaacgacgggtccgtgttatttcgtgtgcgagacgccaacgagcaccgtggcttggtacgttggtcgggggaccaacgggaaccctgggtcctaccgggttcctccctcaccggcccctacccgaacccgaacggggtcccccaacgttccccggtccttccccccggtgggtcccgccccgttcggcccttcccggaacggtccgccgcccgttcccggaaggaccgccaacggcggcccgggccccgttggggtccc

SEQ ID NO: 350009 - DNA, 718 bp, Homo sapiens
  misc_feature: GZ8MTXP01BUJYI.44.78.H01.1.454.CMB.2.raw
  modified_base (308)..(308): a, c, t, g, unknown or other
  misc_feature (308)..(308): n is a, c, g, or t
  modified_base (343)..(343): a, c, t, g, unknown or other
  misc_feature (343)..(343): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctagtagtggacaacgacgggtctttcgcccagaagtccaaggcagagttagtatgaccaggacnccaccctcccaggtacagtctacagtggaactgancagcctgagatcgtgacggaaccgacgggtccgttagttaacgttttcgtggttcggacggaaggaccggaccccaaaccgaacggtccgtaacccggttggggtcctttacgggtacgttttggggtccggggggaacccgaacgggggtaaccccttggggtacccctaacccgggggttccttccccggttaccaccgtcccctaccccgaacccggtaaaccggggcccctacggttccccgggttccccgtttccccccggtgggccccgtccccgttacggccccttacccggacgggaaccgcccgttaccccgttcccggaaggcgaaccccgaacggccgggcccgggtccccgttcggggtcccg

SEQ ID NO: 350010 - DNA, 753 bp, Homo sapiens
  misc_feature: GZ8MTXP01CK3CY.44.78.H01.1.454.CMB.2.raw
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaacgtgggtgcgacaggccgctggacaagggctggagtggatgggatggatgaacgcctagtaggtgacaacgacgggtcttcgaccagaagtcaaggcagagtagtatgaccaggacgccaccctcccaggtacagtactaacagtaggaactgacgcaacgccgtagagtataccgtaggaaccggaccgtacgggtccgttagttacgttttcgtgtcggacgagacgccccaacgacgacctaccgtgggtccttaggtacgttggggaccggggtacccgaacggggtaaccccctggggtaccccaccggttccttacccgacgtaccggaccccttaaccccggaaaccggtaacccggggcccccttaagggtttcccccggttccccgtttcccccccggtcggggtcccccgcccccgttcgggaccccgttcccggaacgggggttaaccccaccccggtaacccgttacccgggaaacggtacccgttaccggaaccggacccggggtccccgggtccccggttcggggtcccgtacccggttacccggtttaacgggttaaccgtaaaccgg

SEQ ID NO: 350011 - DNA, 641 bp, Homo sapiens
  misc_feature: GZ8MTXP01A93LE.44.78.H01.1.454.CMB.2.raw
  modified_base (196)..(196): a, c, t, g, unknown or other
  misc_feature (196)..(196): n is a, c, g, or t
  modified_base (300)..(300): a, c, t, g, unknown or other
  misc_feature (300)..(300): n is a, c, g, or t
  modified_base (322)..(322): a, c, t, g, unknown or other
  misc_feature (322)..(322): n is a, c, g, or t
  modified_base (375)..(375): a, c, t, g, unknown or other
  misc_feature (375)..(375): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtncgacaggccgctggacaagggctggagtggatgggatggatgaagccctatagtggcaacgacggctttgcccagaagtccaaggcagagttagatgacaggancacctccccagtacagtcacanggaactgagcagctagagatcgtagacggaacacgggtccgttgtactttcgngtcgcgagacgcccacgagaccaccgttggcttagaccgtttgggtacggggccgaacggggtaacccctgggtacccacccggggttctacccgtccgaccgtcccctacccgaacccgaaccggggcccctaaggtccccggttcccttcccccggcggtccccgtcccgttacgcccgttccgaacgggtcccgacccgttacccggttcccggaacgggacccgccgtaccgggccggttcccgggtcccggttcgggtccg

SEQ ID NO: 350012 - DNA, 576 bp, Homo sapiens
  misc_feature: GZ8MTXP01A1YSQ.44.78.H01.1.454.CMB.2.raw
  modified_base (300)..(300): a, c, t, g, unknown or other
  misc_feature (300)..(300): n is a, c, g, or t
  modified_base (332)..(332): a, c, t, g, unknown or other
  misc_feature (332)..(332): n is a, c, g, or t
  modified_base (380)..(380): a, c, t, g, unknown or other
  misc_feature (380)..(380): n is a, c, g, or t
  modified_base (395)..(395): a, c, t, g, unknown or other
  misc_feature (395)..(395): n is a, c, g, or t
  modified_base (515)..(515): a, c, t, g, unknown or other
  misc_feature (515)..(515): n is a, c, g, or t
  modified_base (540)..(540): a, c, t, g, unknown or other
  misc_feature (540)..(540): n is a, c, g, or t
  modified_base (555)..(555): a, c, t, g, unknown or other
  misc_feature (555)..(555): n is a, c, g, or t
  modified_base (569)..(569): a, c, t, g, unknown or other
  misc_feature (569)..(569): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacggcttgcccagagtccaaggcagagttagtatgaccagganccacctcccaggtacagtctacatggactgancagcctagagatcgtagacggaaccacgggtccgttagttactttcgnggtcgacggtagacncccaccgacggccaccgtggcttagacgttgggtcggggaccacgggtacccgtggtcccaccggggttcctcctccgacgccctccaaccgacggcccctagtcccggtccttccccgnggccctccttacgccttcgacggcnccgccttccgaagcncacgcgcggtccgngggtccc

SEQ ID NO: 350013 - DNA, 706 bp, Homo sapiens
  misc_feature: GZ8MTXP01BC472.44.78.H01.1.454.CMB.2.raw
  modified_base (348)..(348): a, c, t, g, unknown or other
  misc_feature (348)..(348): n is a, c, g, or t
  modified_base (632)..(632): a, c, t, g, unknown or other
  misc_feature (632)..(632): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggattacacgttcatcaatttatgattattaacgtgggtgcgacgaggccgcgtggacaagggctggagtggagtgggatggatgaacgcctagtagtggacaacgacggtcttgccagaagtccgaaggcagagttagtatgaccgaggacgccacctcccgaggtacagtctacatggaactgacncacgcctagagtatcgaggacggaacgccggtcgttgttactttgtcgtacggacgagacgaccacgacggacctacgtcggtcgttacgtacgttcgggcggggtaccgacgggtaacccgtcggtacccgtccgggttaccgtcccgttaccgaccggtaccccgttaacccgaacccggtaaaccggggtcccccgttaacggtttccccgggtttaccccgtttccccccgggttcgggccccggtccccgttcggtacccgttaccggacggggtaccncccgttacccggttacccggaagggaccgtaaccggaaccggtccgggacccgggtcccggttccggggtcccg

SEQ ID NO: 350014 - DNA, 589 bp, Homo sapiens
  misc_feature: GZ8MTXP01CLFHA.44.78.H01.1.454.CMB.2.raw
  modified_base (307)..(307): a, c, t, g, unknown or other
  misc_feature (307)..(307): n is a, c, g, or t
  modified_base (399)..(399): a, c, t, g, unknown or other
  misc_feature (399)..(399): n is a, c, g, or t
  modified_base (468)..(468): a, c, t, g, unknown or other
  misc_feature (468)..(468): n is a, c, g, or t
  modified_base (532)..(532): a, c, t, g, unknown or other
  misc_feature (532)..(532): n is a, c, g, or t
  modified_base (548)..(548): a, c, t, g, unknown or other
  misc_feature (548)..(548): n is a, c, g, or t
  modified_base (581)..(581): a, c, t, g, unknown or other
  misc_feature (581)..(581): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagccgtggggcctcagtgacagtctcctgcacggcttctggatacacgttcatcaattatgattattaacgtgggtgcgacaggccgctggacgaagggctggagtggagtggatggatgaacgcctagtagtggacaacgacgggtcttcgaccctaagaacgtccgaaggcagtaagttagtangaccaggacgccaccctacccgaggtacagtctacagtacggaactgagcagcctagagatcgtagacggaacgacggtcgttgtatttcgngtgacgagacgccacagcacgtggcttgacgttggccgggacacgggacctgtaccaccggtctccgtnaccgccctaccgaccgaacggccctacgtcccgttccctccccgtggccctcccgttacggccncccggagccgttaccncccgcgaacgcgccgacgccggttccgtcccgngggtcccg

SEQ ID NO: 350015 - DNA, 617 bp, Homo sapiens
  misc_feature: GZ8MTXP01BNWL4.44.78.H01.1.454.CMB.2.raw
  modified_base (313)..(313): a, c, t, g, unknown or other
  misc_feature (313)..(313): n is a, c, g, or t
  modified_base (428)..(428): a, c, t, g, unknown or other
  misc_feature (428)..(428): n is a, c, g, or t
  modified_base (459)..(459): a, c, t, g, unknown or other
  misc_feature (459)..(459): n is a, c, g, or t
  modified_base (488)..(488): a, c, t, g, unknown or other
  misc_feature (488)..(488): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggtattcactttcagtaacgcctggatcgaccgtgggtcccncgaggcctccggaggggagggctggagtgggtggccgtatagaaacaagctggacggtggacagcgagactaacgctgcacccggtagaaacgcaagactacaccatcacaaagngatagaaattacgaaaagtcgttaacgggtntactacgtagggacaagaattacgaaacncgaccctaggaaaacccgaccggaaggaacccaccgacgtaacccgttacttacgttacgttgtcgtgggttagtttcggttacgaagttcccgggcaacggggacccttcgggtccttaacccggtcc

SEQ ID NO: 350016 - DNA, 848 bp, Homo sapiens
  misc_feature: GZ8MTXP01A5IFQ.44.78.H01.1.454.CMB.2.raw
tcagacagtatatacacgaccggtgctcgatttagtgtgagtagtttgggtttgggggcctgggcctcaggaagcagcatcggaggtgcctcagccatggcatggatccctctcttcctcggcgtccttgcttactgcacagggtccgggcctcctctgacctgactcagccatcctcactgtccgtcgtccccaggacacacagtcactattacctgctctaggggaaaacttgagtgataattgcttctggtatcagcagaggccaggccacgccccctatcgctggtcattcttcaggtataataagcggccctgagggactcccgtgacgccgtctttctccgtcgggcctacccgtaaaccgttccgtaacgggggaaacccgtcccggggacccctaaaccgttcccgtaacggaacccctaacgttccgaaaccggcccggaccgaacccccgacggccccgttaccgtaggggtaaaccgttgggaacggggtcgttacgggtaaaccgtttaactttaaaccggttcggttaccggggtaaaggggtaaccggggttaaaggggggtaaaacgtttaggaacccggttttaaaggggtttaggggggtttcggggttttaccgggggtaccgggggttaaacgggggtaaccccgaaagggggtcccgtttaacggggttaccccggttttacccggttacccgggggttaccgtaaccggggttaccccccgaaacgggggttccccgttccccgggtaccccccccggtttccggggttacccctaaacccgtttccccggtttccccggttttaaccccccccgttaacccccccg

SEQ ID NO: 350017 - DNA, 675 bp, Homo sapiens
  misc_feature: GZ8MTXP01B2RFH.44.78.H01.1.454.CMB.2.raw
  modified_base (309)..(309): a, c, t, g, unknown or other
  misc_feature (309)..(309): n is a, c, g, or t
  modified_base (333)..(333): a, c, t, g, unknown or other
  misc_feature (333)..(333): n is a, c, g, or t
  modified_base (521)..(521): a, c, t, g, unknown or other
  misc_feature (521)..(521): n is a, c, g, or t
  modified_base (564)..(564): a, c, t, g, unknown or other
  misc_feature (564)..(564): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactggggtgcgacaggccgctggacaagggctggagtggatgggatggatgaagcctatagtgcaacgacgggtcttcgcccagaagttccaaggcagtagtagtatgaccaggacgcaccctcccgaggtacagtctanataggaactgagacagcctagagntcgtaggacggacgtacggtcgtgtatttcgtgtcgcgagacgcccaacgacgcaccgtggtcttagggacttggggacgggccgaaacggggtaccccttgggacctacccgttctaccctacgtacccgaccccgtccgaacccgaaccggggccccttacgttccccggtcccctttcccccggngggtcccctcccgtacggtcccgtcccggaaggggtaaccccncccggtaaacccgaccggaacgacccgttacccgaccgggttccccggggccccggtcccgggtcggggtcccgtccgggttacccggttaacgggttaacccgtaaacgg

SEQ ID NO: 350018 - DNA, 643 bp, Homo sapiens
  misc_feature: GZ8MTXP01ATQYK.44.78.H01.1.454.CMB.2.raw
  modified_base (281)..(281): a, c, t, g, unknown or other
  misc_feature (281)..(281): n is a, c, g, or t
  modified_base (367)..(367): a, c, t, g, unknown or other
  misc_feature (367)..(367): n is a, c, g, or t
  modified_base (419)..(419): a, c, t, g, unknown or other
  misc_feature (419)..(419): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctcgtaggggaaacttgagtgataaattgcttctgtatcagcagacggcaggccacgccccctangctggtcatcttcaggataagtaagcggccctcgagggactcccgtgacgcgtcttctccgtggctccgaactcgtaagggaaccncggccactctcgacctatcgacgccgaccgacccacggccctcgtacggagnggacggctagaccttaagttactgtacggaggtacgggtagggtaaacgtgtacgttaaggtttggggtacggttcggggacgggtacgggaaccgtaagggtccgtcggttacccggttcgttccgggtaccgaaccggttccccggttaaacgggttcccgtcccggtccccccgtcgggttaccctacccgttcccgttcccggtttcccccggttccccc

SEQ ID NO: 350019 - DNA, 549 bp, Homo sapiens
  misc_feature: GZ8MTXP01BXY5O.44.78.H01.1.454.CMB.2.raw
  modified_base (236)..(236): a, c, t, g, unknown or other
  misc_feature (236)..(236): n is a, c, g, or t
  modified_base (497)..(497): a, c, t, g, unknown or other
  misc_feature (497)..(497): n is a, c, g, or t
  modified_base (510)..(510): a, c, t, g, unknown or other
  misc_feature (510)..(510): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtgcaacncgggcttgcccagagttccaaggcagagtagtatgaccaggagcacctccccaggtacagtctacatggaactgagcagcctgagatcgtgacggacacggccgtgtatttcgtgtggcgagacgcccacacgcaccctgggcttggacgttggtcggggcccaaggggacccctggtccaccgtctcctcacgcctaccaccgacgggccctagtcccggtccttcccccgtggccctccctgccctccgaagggacccnccacccgcgagcnccgcgcggccgccgtgggcctcggccgtcggaacgaacg

SEQ ID NO: 350020 - DNA, 659 bp, Homo sapiens
  misc_feature: GZ8MTXP01CILCH.44.78.H01.1.454.CMB.2.raw
  modified_base (262)..(262): a, c, t, g, unknown or other
  misc_feature (262)..(262): n is a, c, g, or t
  modified_base (306)..(306): a, c, t, g, unknown or other
  misc_feature (306)..(306): n is a, c, g, or t
  modified_base (490)..(490): a, c, t, g, unknown or other
  misc_feature (490)..(490): n is a, c, g, or t
  modified_base (557)..(557): a, c, t, g, unknown or other
  misc_feature (557)..(557): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggattttcctgctgcttattttaaaaggtgtccagtgtgaggtgcagttggtggagtcgtgggggaggtttggaagcgtggggatcctagctctctgtgcagcctntggattcactttcagtaacgcctggactcgaccgtcgggtcccncgaggcctccgaggggaggggcgtggaggtggggttcggaccgttaagtaacgaaccaaaggcgtagggacggtacggacagacgaaggactaacggcctcggaccaacccgggtaggaaacggcaagtacttaccaacctatactacgaaagagatagtaacttaacaaaagtagttacggtntacgtcacgggacaagtataacgaacgacgaccaggaaacccgacggaacgaacacgacgtcccgtntttacgtaccgttggttacgttggggttacgtttcggttcgtaacggttcccggggtaaccgtaaccggggtacccgttacgggtcccttccgggttccccg

SEQ ID NO: 350021 - DNA, 621 bp, Homo sapiens
  misc_feature: GZ8MTXP01D0OFN.44.78.H01.1.454.CMB.2.raw
  modified_base (362)..(362): a, c, t, g, unknown or other
  misc_feature (362)..(362): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctaatagtggcaacgacgggctttgcccaagaacgttccaaggcaagagtagtatgaccagagccacctccccaggtacagtactacatagaactgagcagcctgacgatctgacggacacgggccgtgttactttcngtgcgagacgaccacagcacgtgcttgacgttggtcggggaccaacggggtaccctggtcccaccggttacctcctaccgacgcccctacccgaaccgaaccggggtccctaacgtcccggtcccttccccgtgggccctcccgttacgccctccggaacggccgcctacccgttacggaacgacgaccgaccggaccgggtccccggacccggtggggtcccgtcggttccccgttaagggttaaccgtaaaaccggg

SEQ ID NO: 350022 - DNA, 682 bp, Homo sapiens
  misc_feature: GZ8MTXP01BOPFJ.44.78.H01.1.454.CMB.2.raw
  modified_base (284)..(284): a, c, t, g, unknown or other
  misc_feature (284)..(284): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacgacgggtcttcgcccagaagttccaaggcagagtagtatgaccagganccaccctcccagtacagtactacataggaactgagcagcctagagactcgtggaaccggaccgacggtccgttagttactttcgtggtcgcggaacgacgacccaccgacgacctacccgtggtcgtttcggacgttgggtaccggggacccgtaacgggggtaaccccttgggtacccacccggttcctccgtacgaccgtcccgtacccgaaccggaaccgggccctacgtcccggtccccttccccggtcggcccgtccccgtcgcccctcccggaaacgggtcccgaccccgtacccgttaccgggaacgaccgacccgacccggccgggccccgggtccccgggtcgggggtccctccgggccccggttaacgggttaacccgtaaaccgggg

SEQ ID NO: 350023 - DNA, 616 bp, Homo sapiens
  misc_feature: GZ8MTXP01CM9I7.44.78.H01.1.454.CMB.2.raw
  modified_base (283)..(283): a, c, t, g, unknown or other
  misc_feature (283)..(283): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagtagtatgaccaggancacctccccaggtacagtctacatggaactgagcagcctgagatcgtggacggacacggccgtggtatttcgtggtcgcgacgacgcccacagcacccgtggtcttggacgtttcggtcgggggcccaaggggtaaccccttgggtacccgtacccgtccgtccctcgaccggtccctcccgaaccgaaccggggccccaagttccccgggtcctttcccccgtcgggcccgtccccgttacggccctcccgaagggaccgccgaccccgttcggacgacgccgaccacgggcccggcccgttggggccttcgggcctggggttcctaacggg

SEQ ID NO: 350024 - DNA, 562 bp, Homo sapiens
  misc_feature: GZ8MTXP01CUS5Y.44.78.H01.1.454.CMB.2.raw
  modified_base (356)..(356): a, c, t, g, unknown or other
  misc_feature (356)..(356): n is a, c, g, or t
  modified_base (470)..(470): a, c, t, g, unknown or other
  misc_feature (470)..(470): n is a, c, g, or t
  modified_base (509)..(509): a, c, t, g, unknown or other
  misc_feature (509)..(509): n is a, c, g, or t
  modified_base (530)..(530): a, c, t, g, unknown or other
  misc_feature (530)..(530): n is a, c, g, or t
  modified_base (544)..(544): a, c, t, g, unknown or other
  misc_feature (544)..(544): n is a, c, g, or t
  modified_base (555)..(555): a, c, t, g, unknown or other
  misc_feature (555)..(555): n is a, c, g, or t
tcagacagtatatacacgaccggtgctcgatttagtgtgagtagtttgggtttgggggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttcagcgacaattccactggaccctttaaagtctctatcatggtacgcagtggtcccggccgagcccccaaagtcctctttacgacgtcctttcgcggcttcggcagtccctggccgtttttcggcctccagtttcngaccacgcggcctccctcgaccatcaccaaactcccggctgagatgagctgactactttgttgtgctatatttcgattcactcaaatatgtcttcggaaggttcgggaccccgngttcagccgtctgcgtcagccccaaggcccaaaccccgnttcgtccactctcgttccccncccttcctctactntactgttctgngtccggg

SEQ ID NO: 350025 - DNA, 635 bp, Homo sapiens
  misc_feature: GZ8MTXP01DXX29.44.78.H01.1.454.CMB.2.raw
  modified_base (309)..(309): a, c, t, g, unknown or other
  misc_feature (309)..(309): n is a, c, g, or t
  modified_base (550)..(550): a, c, t, g, unknown or other
  misc_feature (550)..(550): n is a, c, g, or t
  modified_base (606)..(606): a, c, t, g, unknown or other
  misc_feature (606)..(606): n is a, c, g, or t
  modified_base (613)..(613): a, c, t, g, unknown or other
  misc_feature (613)..(613): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgtttcatcaattatgattattaacgtgggtgcgacaggccgctggacaagggctggagtggatgggatggatgaagccctaatagtggacaaacgacgggtcttgcccaagaagtccaaggcagagttagatcgacaggancacctcccaggtacagtctacagtcggaactgacgcacgcctgagatctaggacgaaccgacgggtccgtgttatttcgtgtacgcgaagacgcccacgacgcaccgtggtacctttggtaccgttgggtaccggggccgtaaacggggtaccgttacgggtcccaacccggggttcttacccttcgaaccgccctacccgaccgaacgggtcccctaagtccccggttcccttccccggnggcccgtccccttgggacccttccgaacggtccgaccgccgttacccgaagaaccnccgaacncggcccggtccgttcggggtcc

SEQ ID NO: 350026 - DNA, 589 bp, Homo sapiens
  misc_feature: GZ8MTXP01CLX3T.44.78.H01.1.454.CMB.2.raw
  modified_base (302)..(302): a, c, t, g, unknown or other
  misc_feature (302)..(302): n is a, c, g, or t
  modified_base (498)..(498): a, c, t, g, unknown or other
  misc_feature (498)..(498): n is a, c, g, or t
  modified_base (533)..(533): a, c, t, g, unknown or other
  misc_feature (533)..(533): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatggggatggatgaagccctatagtggcaacacgggctttgcccagaagtccaaggcagagttagtatgaccaggncaccctccccaggtacagtctacatggaactgagcagcctgagatcgtgaggaacacgggccgtgttatttcgtgtgcgagacgccacgagcacgtggcttgacgttggcggggaccacgggtaccctggtccacccggggtctaccgtcacgccctccgaccgacgggccccagttcccggtccctttcccccgnggccccgtcccgttcgcccgttcccgacgggaccncccgttacccgttccggaacgacgccgaccgcggcccggtccccggttgggccccg

SEQ ID NO: 350027 - DNA, 673 bp, Homo sapiens
  misc_feature: GZ8MTXP01CN4KC.44.78.H01.1.454.CMB.2.raw
  modified_base (378)..(378): a, c, t, g, unknown or other
  misc_feature (378)..(378): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtaggggaaacttgagtgataattgcttctgtatcagcagaggccaggccacgcccctatcgctggtctatctttcaggataataacgccggccctgacgggtactcccgtaggacgtcgtcttctcccgtcggcctcctaaacgtcgtaacgggaaccnccggcctactcgtacgaccatccgacgcccgaccgaccccacgtccctcgtagggagttcggacggtccgtagtacttaacgttacgtggttaccggaagggtaccggggtaagggtaaacgttcggtaaccgttaagggtttcggggttacgggttccggggacggggtaacgggaacccgtaagggtccgttacggttacccggtttacgttccggtaccgaccggttacccggacggcccgtcccggtacccccgttcggtcccaccgtttcccgtccgttcccccgtcccc

SEQ ID NO: 350028 - DNA, 698 bp, Homo sapiens
  misc_feature: GZ8MTXP01COHHI.44.78.H01.1.454.CMB.2.raw
  modified_base (276)..(276): a, c, t, g, unknown or other
  misc_feature (276)..(276): n is a, c, g, or t
tcagacagtatatacacgaccggtgctcgatttagtgtgagtagtttgggtttgggggaagcagcatcggaggtgcctcagccatggcatggatccctctcttcctcggcgtccttgcttactgcacagggtccgggcctcctctgacctgactcagccatcctcactgtccgtgtccccaggacacacagtcacttattacctgctacgtagggtaaacttgagtgaattaaattgtcttctggtatcagcaggcgccacggcccacgcccctancgctggtctatctttacgaaggtaataacgtaacggcccggtacccctacggaacggggtacttccccgtaggacgtcgttcttacctcgttcggaccctacctacgttcccgacgggacaccggcctaaccgtcctacgaaccatccgacgccgacccgacccgacgcccttagaggtacgtacggtacggcctaggacctttagttaaccgtggttacgagtaacgggttaggggaaagttggggtacgtttaaagggttcgggggtcggttacgggaccgggaggaaccgtaacgtcgtaacggttccgttccggttacgggtccaaccggcccgaaacggccgttccccggccccgttcggttaccttccgttcccgtcccgtttccccgcccttacccttataacttaacgtttccg

SEQ ID NO: 350029 - DNA, 568 bp, Homo sapiens
  misc_feature: GZ8MTXP01AU3Z2.44.78.H01.1.454.CMB.2.raw
  modified_base (339)..(339): a, c, t, g, unknown or other
  misc_feature (339)..(339): n is a, c, g, or t
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
  modified_base (503)..(503): a, c, t, g, unknown or other
  misc_feature (503)..(503): n is a, c, g, or t
  modified_base (510)..(510): a, c, t, g, unknown or other
  misc_feature (510)..(510): n is a, c, g, or t
  modified_base (542)..(542): a, c, t, g, unknown or other
  misc_feature (542)..(542): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggctttgcccagaagtccaaggcagagttagtatgaccaggacgccaccctcccgagtacagtctacagtggaactgancagcctagagatcgtgacggaacacgggtccgtgttatttcgngtgcgagacnccacngcncgtgcttgacgttgcggggaccacgggacctgtcctaccgggtctcctcacgtccctacccgacgaccggtcccacgtccgtccctccccgtcggcctccccnggtcccncggacggcgccgttcccgaccgaagccgaacncgacggcccggcccgttcggggcccg

SEQ ID NO: 350030 - DNA, 715 bp, Homo sapiens
  misc_feature: GZ8MTXP01CFUBH.44.78.H01.1.454.CMB.2.raw
  modified_base (301)..(301): a, c, t, g, unknown or other
  misc_feature (301)..(301): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaacgtgggtgcgacaggccgctggacaagggctggagtggatgggatggatgaagccctatagtggcaacgacggtcttgcccagaagtccaaggcagagtagtatgacaggancacctcccaggtacagtctacatggaactgacgcacgcctagagtatcgtaggaacggaaccgaccgggtccgttagtttaacgtttccgtggtacggacggaacgaccgacccaaccgacgtacccgtaaccgttgggtaccgtttacggtaaccggtttcggggaccgggggtacccgaaaccggggtaaccccgtcgggttaccccgtaaccccgggttcccgttacccgtccgaacccgtccccgtaaccccgaacccgggaaaccgggtcccctacggttccccgggtttccccttcccccgggtcggccccgtcccgttcggtccccttaccggaaacgggccgacccgttcccgttaccggaaggacgaacccgaacggccgggcccggtcccggttcggggtcccg

SEQ ID NO: 350031 - DNA, 506 bp, Homo sapiens
  misc_feature: GZ8MTXP01BFPKA.44.78.H01.1.454.CMB.2.raw
  modified_base (236)..(236): a, c, t, g, unknown or other
  misc_feature (236)..(236): n is a, c, g, or t
  modified_base (374)..(374): a, c, t, g, unknown or other
  misc_feature (374)..(374): n is a, c, g, or t
  modified_base (389)..(389): a, c, t, g, unknown or other
  misc_feature (389)..(389): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (461)..(461): a, c, t, g, unknown or other
  misc_feature (461)..(461): n is a, c, g, or t
  modified_base (465)..(465): a, c, t, g, unknown or other
  misc_feature (465)..(465): n is a, c, g, or t
  modified_base (478)..(478): a, c, t, g, unknown or other
  misc_feature (478)..(478): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggangttaagccctatagtggcaaacacgggctttgcccagaagtccaaaggcagagttagatgaccaggagcacctccccaggtacagtctacatggaactgagcagcctgagatctgaggaacacggccgtgtaatttcngtgcgagagcaccancacngntgctgtggcgacgacgtcgcncgtctcncncnccnccaccaacgccactcgtcctccctcgcgccncgcncgacgacgcgccnccgaacgacgcacacgccgccgcggtcg

SEQ ID NO: 350032 - DNA, 708 bp, Homo sapiens
  misc_feature: GZ8MTXP01AN27J.44.78.H01.1.454.CMB.2.raw
  modified_base (275)..(275): a, c, t, g, unknown or other
  misc_feature (275)..(275): n is a, c, g, or t
  modified_base (507)..(507): a, c, t, g, unknown or other
  misc_feature (507)..(507): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggtattttccttgctgcttattttaaaaggtgtccagtgtgaggtgctaggttggtggagtcgtgggggtaggtttaggtaaagccgtggggacgtccttagactctctgtgcagcctntggtacttcactttcagtacgctggactcgaccgtggccgccgaggcctccggaggggaggggtctgggtaggtggggttcggaccgttaagttacgaaacgaaagcgtggacgggtcgggacaggcgaagactaacgctcgactaacccggtagaaacggcaacgtacttaccacctagttccgacgaaagtagataggtaaattaaacgaaaagtacgttaaccgggttnttaccgtcgtaggacgtaaagtacgtaaacgaaccgtacgacccgtaaacgaacccgaccggaaccgacaccggtaacgtcccgttaattacggttacgttcggttacggttagggttacgttttcgggttaccggtaaccgggttcccggggtaacccgtaacggggtacccgttcgggtaaccccgttaacccgttccg

SEQ ID NO: 350033 - DNA, 807 bp, Homo sapiens
  misc_feature: GZ8MTXP01BTMPN.44.78.H01.1.454.CMB.2.raw
  modified_base (274)..(274): a, c, t, g, unknown or other
  misc_feature (274)..(274): n is a, c, g, or t
tcagacagtatatacacgaccggtgctcgatttagtgtgagtagtttgggtttgggggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtaggggtaaacttgagttagtattaaatttgcttctggtatcagcagacgcaggccacgcccctancgctcggtcacttcttcaggtatagtaacgccggccctgacggtctccgtaggacgtccgtcttcgtcgtcggacctacgtaaccgtccggaaccgggtaaccaccgggtaccctaactaccgtaccgtaaccctagtacccgaacggaccccgaacccggtacccccgtaaggtcccccgttaacggtcgggtaacgtttacgggaaccggttaccgttaacggttaaccctttaacgtttaaccggtacggtaaccggtaaaccggggtaaccgggtttaaagggggtaaacggttacggggttaacggttttaaacggggttttcgggggtacggtttacccgggggaacggggaaccgggtaaccgtaaacgggttcccgtaacgggtacccgtttacggtccgggtaaccgtaacgggaccccgtaacgggttcccgttcccgggtcccccgttacgggttccccttacggtttaacccgtcccgtttcccctaccccttccgttacttaacgttaaccttaaccggg

SEQ ID NO: 350034 - DNA, 541 bp, Homo sapiens
  misc_feature: GZ8MTXP01AQESN.44.78.H01.1.454.CMB.2.raw
  modified_base (369)..(369): a, c, t, g, unknown or other
  misc_feature (369)..(369): n is a, c, g, or t
  modified_base (481)..(481): a, c, t, g, unknown or other
  misc_feature (481)..(481): n is a, c, g, or t
  modified_base (499)..(499): a, c, t, g, unknown or other
  misc_feature (499)..(499): n is a, c, g, or t
  modified_base (534)..(534): a, c, t, g, unknown or other
  misc_feature (534)..(534): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagtccaaggcagagttagtatgaccaggagcacctccccaggtacagtctacatggaactgagcagcctgagatctgaggaacacggcgtgtatttcngtgcgagcgccaccagcacctggcttgacgtttggtcggggccagggaccctggtccaccgggtctcctcacgcctccaccgaacggcccatccggtcctccccgtggcccncccttgccttccgaggcnccgccttccgaagacgccacgacgttccggcccgnggggtcc

SEQ ID NO: 350035 - DNA, 655 bp, Homo sapiens
  misc_feature: GZ8MTXP01BKHDD.44.78.H01.1.454.CMB.2.raw
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtgcaacacgggcttgcccagaagttccaaggcagagtagatgacagagcacctcccagtacagtctacatggaactgagcagcctagagatcgtgacggacgacggccgtgtatttctgtgcgagacgaccaccacgcaccgtgggtcttcggacgttgggtcggggccctaacgggggaaccccttgggtccaacccggttcctcctacgaccggccctacccgaacccgaaaccggggcccctacgtccccgggttccccttcccccggtgggccccgtcccccgttagccccgttcccgaacggggtaaccccgcccgtaaccccggttaccggaacggacccgacccgaccggacccgggtccccgggtccccggtcgggcccgtccgggttaccccggttcggggttaaccgtaaaccggg

SEQ ID NO: 350036 - DNA, 694 bp, Homo sapiens
  misc_feature: GZ8MTXP01E2ZBC.44.78.H01.1.454.CMB.2.raw
  modified_base (309)..(309): a, c, t, g, unknown or other
  misc_feature (309)..(309): n is a, c, g, or t
  modified_base (586)..(586): a, c, t, g, unknown or other
  misc_feature (586)..(586): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgcgtggacaagggctggagtggatgggatggatgaagcctatagtggcaaacgacgggtcttgcccagaacgtccgaaggcagtagttagtatgaccgaggacnccaccctccccgaggtacagtactacagtggaactgacgcagcctagagatcgtagacggaaccgacgggtccgttagttaactttcgtggtacggacggacgacgcccgaaccgacgccgtaccgtggtactttacggtacgtttcggggaccggggacccggaacgggtaaccccgtgggtaccccgtacccggggtcccttacccgtccgaccggtcccctaccccgaacccgaaccggggtacccctacggttccccggttcccttcccccgngggtccccgtccccgttcggccccgttaccgacgggtaccgaccccgttacccgttcccggaacgaccgaaccgaaccggccggcccgggtcccgttcggggtccccg

SEQ ID NO: 350037 - DNA, 767 bp, Homo sapiens
  misc_feature: GZ8MTXP01EABS9.44.78.H01.1.454.CMB.2.raw
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaacgtgggtgcgacaggccgctggacaagggctggagtggatgggatggatgaagccctagtagtggacaacgacggtcttcgcccaagaagtccaaggcagagttagtatgacaggacgcacctcccaggtacagtactacagtaggaactgacgacacgcctagagtatcgtacggaacggaaccgtaaccgggtccggttagtttaacgtttccgtgggtcggacgggaaggaccgacccaaccgacggccaaccggttggtactttaggtaccgtttggggtcgggggacccgaaaccgggggtaaccccgttggtaccccgtaaccggggttccccgttacccgtacccgtaccggcccccttaaccccgaaaccccgggtaaaccggggtccccccttaacggttcccccgggtttccccgtttcccccccgggtcggggcccccgttccccgttccggccccgtttacccggaacggggtacccgttaccccgaaccccggttcccggaaccgggtaacgggaacccaaacccgggaccggggccccgggtccccggtttcggggggtccccg

SEQ ID NO: 350038 - DNA, 790 bp, Homo sapiens
  misc_feature: GZ8MTXP01EZYIW.44.78.H01.1.454.CMB.2.raw
  modified_base (272)..(272): a, c, t, g, unknown or other
  misc_feature (272)..(272): n is a, c, g, or t
  modified_base (425)..(425): a, c, t, g, unknown or other
  misc_feature (425)..(425): n is a, c, g, or t
tcagacagtatatacacgaccggtgctcgatttagtgtgagtagtttgggtttgggggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctcgtaggggaaaacttgagtgaataaatttgcttctggtatcagcagagccaggccagccccctangctggtcatcttcaggataataagcggccctcgagggtactcccgtggagcccgtctttccgtctcggcctaccgaactcccgtacgggggaaaccaccgggccctaacctcctacggaaccctaactccgaacggccccgaccgaaaccccncgtccccttccgttaggacggttcggaacgggtcctacgggtaaacttacgttttaaccgtgggttaccgaacggggtaacgggttaaagggggtaaacggtttagggggtaccgttttaaaaggggtttcggggggtttacgggtttaccgggggtacccgggggtaaagggggtaaccccgaaagggtcccggtttaccgggtaaccccggggttttccgtccgggtaaccggtaaccggccccggaaacgggttccccgtacccggtccccccgttccgggttcccttaccccgtttcccggttcccgtttcccccctaacccccgtttcccgttaccttaacgtttaaccctttaacccgg

SEQ ID NO: 350039 - DNA, 681 bp, Homo sapiens
  misc_feature: GZ8MTXP01AEDMK.44.78.H01.1.454.CMB.2.raw
  modified_base (373)..(373): a, c, t, g, unknown or other
  misc_feature (373)..(373): n is a, c, g, or t
  modified_base (389)..(389): a, c, t, g, unknown or other
  misc_feature (389)..(389): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacgagggtccggggcctcctctgacctgactcagccatcctcactgtccgtgtccccaggacacacagtcactattacctgctcgtagggaaacttgagtgattaaatttgcttctggtatcagcagaggccaggccacgccccctatcgctggtcattctttcaaggataaactagcgtccctgagggctcccgtgacgcgtcttctcctcggctaccgacgtcgtacgggaaccncggccactctacgacntcacgcgacgaccagcctcgaggactaggacggtactacggtacttacttacgtcgtacggtacggtaaccggggttagggaaaaggttcgtaaccgtttaaagggttcgggggttacgggtttaccgggggtacggggtaaccggggaaccgtaacgggtccgttacgggttaacccggtttccggttccgggttaccgaacccgggttacccgaacgggttccccgtcccggttccccccggttcgggtccctacccgttccccgtttcccggttcccccggttcccccg

SEQ ID NO: 350040 - DNA, 622 bp, Homo sapiens
  misc_feature: GZ8MTXP01ARVD5.44.78.H01.1.454.CMB.2.raw
  modified_base (569)..(569): a, c, t, g, unknown or other
  misc_feature (569)..(569): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcaatgacagtctcctgcacggcttctggatacacgttcatcaattatgatattaacgtgggtgcgacaggccgctggacgaagggctggagtggagtgggatggatgaagcctatagtggacaacgacggcttgccagaagtccgaaggcagagttagtatcgacaggacgccaccctcccgaggtacacgtactaacagtaggaactgacgacacgcctagacgatcgtaggacgaacgacggtcgtagttatttcgtgtgcgagacgccacgagcaccgtgtcttcgacgttgggcgggaccacgggaacctcggtacccacggttccctccgtccgaccgtaccctacccgaaccgacggggtcccctagttcccccgggttccctttcccccgacgggtccctccccgttcgccccgttacgacgggaccncccgttcccgacggaacgacgaaccgccgacgcccgggtccgttcgggtcccg

SEQ ID NO: 350041 - DNA, 724 bp, Homo sapiens
  misc_feature: GZ8MTXP01BIH2Z.44.78.H01.1.454.CMB.2.raw
  modified_base (302)..(302): a, c, t, g, unknown or other
  misc_feature (302)..(302): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacggcttcgcccagaagtccaaggcagagttagtatgaccagganccaccctcccagtacagtctacatgaactgagcagcctgagatcgtaggacggaaaccacgggtcccgttgttacgttttcgtggtgaccgaagaccgacccaaccgaacggacctaacccgttgggtcctttacgggtaaccgtttggggtaccgggggacccgaaacgggggtaaaccccgttcgggtaccccgtaacccggggttccttaccccgtccgaaccggtcccctaccccgaacccggaaaccggggccccctaacggttccccgggttccccttcccccccggttggggcccccgtcccccgttcggtaccccgttcccggaacgggtacccgccccgaaccccggttacccggaacggaccggcccgaaacccggaccggggccccgggtccccgggttcgggggtccccg

SEQ ID NO: 350042 - DNA, 611 bp, Homo sapiens
  misc_feature: GZ8MTXP01BZDOI.44.78.H01.1.454.CMB.2.raw
  modified_base (239)..(239): a, c, t, g, unknown or other
  misc_feature (239)..(239): n is a, c, g, or t
  modified_base (544)..(544): a, c, t, g, unknown or other
  misc_feature (544)..(544): n is a, c, g, or t
tcagacagtatatacacgaccggtgctcgatttagtgtgagtagttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtgcaacacggnttgcccagagttccaaggcagagtagtatgaccaggacgccaccctccccgaggtacagtctacagtggaactgagcagcctagagtatcgtggacgggaccacgggtccgtttgttacttttcgtggtcggcgaacgacgacccaccgacgccaccgtggtcttggtacgttgggtcggggaccgtaaccggggtacccttgggtcccacccgttcctcccgtcaccgtcccgtacccgaccgaccgggcccctacgtccccggtcccttccccgtcggccctccccgtgccctccggcggacncccgtacccgttccgaggcaccgcgacggcccgggccgtcgggcctcggccgtggttaaccgaacgg

SEQ ID NO: 350043 - DNA, 635 bp, Homo sapiens
  misc_feature: GZ8MTXP01CF5HX.44.78.H01.1.454.CMB.2.raw
  modified_base (491)..(491): a, c, t, g, unknown or other
  misc_feature (491)..(491): n is a, c, g, or t
  modified_base (559)..(559): a, c, t, g, unknown or other
  misc_feature (559)..(559): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggtattttccttgctgctattttaaaaggtgtccagtgtgaggtgcagttggtggaggtcgtgggggtaggtttggtaaagcgtgggggacgtcccgttagactctcctgtgcagcctctggtattctacttcagtaacgcctggatcgaccgtcgggtccgccgaggccgtccggaggggacggggcgtgggaggtggggttcggccggttattacggaaaccaaagcgtaggacgggtcggacaggacagacctaacgctcgaccaacccggtagaaaggcaggtacttcaccatactacaagacatagaatttaacgaaagtactacgggtnttctcgtaggctaagctaacgaacacgacctagaaccacggagacacgacgccttacttacgttacgngttaccgtgggttacttggggtttccaacggttccgggccgaacgggggtacccttgggtcccgaaccggtttccc

SEQ ID NO: 350044 - DNA, 640 bp, Homo sapiens
  misc_feature: GZ8MTXP01A1VPP.44.78.H01.1.454.CMB.2.raw
  modified_base (565)..(565): a, c, t, g, unknown or other
  misc_feature (565)..(565): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtgacaacgacgggtcttcgcccagaagttccaaggcagagtagatgacaggacgccacccgtcccaggtacagtactacagtacggaactgacgcagcctagagatcgtggacggacgacggtccgtgttactttcgtgtcggacgaagccgaccaccgagcctacccgtgggtcttaggacggttcggggtacggggcccgtaacggggtaacccttggggtaccctacccggttcctccgtcgaacccgtcccgtaacccgaccggtaaccggccctacgtccccggtcccttccccgcggccctccccgtcgcccgtccggaacgggtacccnccgaccgttacggacgcgccgcggccggcccgggtccggtcggccgtccggttccggtaacggttaaccgtaacg

SEQ ID NO: 350045 - DNA, 671 bp, Homo sapiens
  misc_feature: GZ8MTXP01DJJI2.44.78.H01.1.454.CMB.2.raw
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgattattaactgggtgcgacaggccgctggacaagggctggagtggatgggatggatgaagccctatagtggcaacgacgggctttgcccagaagtccaaggcagagttagtatgacaggagcacctcccagtacagtctacatggaactgagacagcctagagatcgtggaacggaaccgacgggtccgttagttacttttcgtggtacgacgaggaccgtcccaaccacgaccctaccgttgggtccgtttaggtaccggttttgggggaccgggggaccccgtaacgggggtaaccccttggggtacccctacccgggggttacccttcccgtaccgaccggtcccctaccccgaaccggtaaccgggggcccctaggttccccggttcccctcccccgtggggcccctcccgttgcccttaccgacgggcacccgttcccgttacgaacgacgccaaccgcggttcccggtaacccgttgggcccg

SEQ ID NO: 350046 - DNA, 585 bp, Homo sapiens
  misc_feature: GZ8MTXP01DO5N5.44.78.H01.1.454.CMB.2.raw
  modified_base (296)..(296): a, c, t, g, unknown or other
  misc_feature (296)..(296): n is a, c, g, or t
  modified_base (355)..(355): a, c, t, g, unknown or other
  misc_feature (355)..(355): n is a, c, g, or t
  modified_base (526)..(526): a, c, t, g, unknown or other
  misc_feature (526)..(526): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtgcaacgacgggctttgcccagaagttccaaggcagagtagatgaccagagcaccctcccaggtacngtcacataggaactgagcagcctagagatcgtagacggacacgggtccgtgtactttcngtgcgtagacgccaccgagccacgtggacttggacgtttgggacggggaccaacggggtacccttgggcctaccggttcctctccgacgccctacccgaaccgaacgggccccagttcccggtcccttccccggcgcccgcccgtagccctccgaaggacgccgtaacccncgaagcgttaccgcgcggccggtcccgtgggcctcggccgttcgggttaactaaaccgg

SEQ ID NO: 350047 - DNA, 634 bp, Homo sapiens
  misc_feature: GZ8MTXP01CGKT8.44.78.H01.1.454.CMB.2.raw
  modified_base (271)..(271): a, c, t, g, unknown or other
  misc_feature (271)..(271): n is a, c, g, or t
  modified_base (379)..(379): a, c, t, g, unknown or other
  misc_feature (379)..(379): n is a, c, g, or t
  modified_base (615)..(615): a, c, t, g, unknown or other
  misc_feature (615)..(615): n is a, c, g, or t
  modified_base (626)..(626): a, c, t, g, unknown or other
  misc_feature (626)..(626): n is a, c, g, or t
tcagacagtatatacacgaccggtgctcgatttagtgtgagtagtttgggtttgggggaagcagcatcggaggtgcctcagccatggcatggatccctctcttcctcggcgtccttgcttactgcacagggtccgggcctcctctgacctgactcagccatcctcactgtccgtcgtccccaggacacacagtcactattacctgctcgtaggggaaacttgagtgattaaattgcttctgtatcagcagacgccaggccacgccccctangctggtcactctttacgaggtaataagtaacggccggtcccctcgaggggtactccccgtaggacgtcgtcttctcgtggcctaccaacgtccccgtacggggaaccnccggaccacctccgtacgaacccatccgaacgggcccgaccgaccccagcccttcgtaggatgaggctagtacttagttacgtcgtacgacggtacggtagggtaaacggttggacgtttaaggttgggggtacggttacgggacgggaacggggtacacggtctcggtaccgtttcgcggtcacggacccgaggccgtccgccccgttggttccttacgttccgtcccgttcccnccctcttactnttcgttcg

SEQ ID NO: 350048 - DNA, 639 bp, Homo sapiens
  misc_feature: GZ8MTXP01EY8BL.44.78.H01.1.454.CMB.2.raw
  modified_base (459)..(459): a, c, t, g, unknown or other
  misc_feature (459)..(459): n is a, c, g, or t
  modified_base (547)..(547): a, c, t, g, unknown or other
  misc_feature (547)..(547): n is a, c, g, or t
  modified_base (580)..(580): a, c, t, g, unknown or other
  misc_feature (580)..(580): n is a, c, g, or t
tcagacagtatatacacgaccggtgctcgatttagtgtgagtagtttggggtttggggggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcaacaattccactggtaccctttaaagtctctatcatggtacgcagtggtcccgggccgagcccccaaagtcctctttacgacgtcctttcgcggctcggcagtcctgtccgttttcgcctcagttctgaccacgcggcctcctcgaccatcaccaaaccgtcccggctggagatggagtctgtacttacttttcgtgtgtctattattcgtaattctactactaaaacttnttgttacgttacgggaagggtcggggaacccgtcgtaccgagtccgtccgtgaccgttcaacggtccccaaacgggccccaaaccccncgttcggtacccaacttccctcgtttacccccnccccgttacccttaactacgttaacttaacctggttacctcgggttaacgtcccggggg

SEQ ID NO: 350049 - DNA, 702 bp, Homo sapiens
  misc_feature: GZ8MTXP01AIRBN.44.78.H01.1.454.CMB.2.raw
  modified_base (697)..(697): a, c, t, g, unknown or other
  misc_feature (697)..(697): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgattaattaacgtgggtgcgacgacggccgcgtagggaacgaagggctgggagtgggagtggggagtaggatagaacgtccctagtaggtggacaacgacggtcttcgacccgagtaacgtaccgaaggctaaggtagttaagtacgtacggaaccgaacggacgaccctaaccccgtaccccgaaggtacacgtacctaacgacgtaggaacgtgacgacgacgccgtaggacgtatcggtaggacggaaaccgtacgggtcgttagtttacgttcgtcggtcggacgacggaccgccctaacgcggacctacggtggttacgttcgacggtttcgggaccggggacccgtaaccggtacccggttgggcccctaccggggttcctaccgtcccgaccggtccctaacccgaaccgggacccgtcctccgttcccgggtccccttcccggcgaacccctcggttcgccttacggcggcttcccgaccgcgcgacgtccgacggcggccccgtcgngtccg

SEQ ID NO: 350050 - DNA, 597 bp, Homo sapiens
  misc_feature: GZ8MTXP01BJTZE.44.78.H01.1.454.CMB.2.raw
  modified_base (353)..(353): a, c, t, g, unknown or other
  misc_feature (353)..(353): n is a, c, g, or t
  modified_base (500)..(500): a, c, t, g, unknown or other
  misc_feature (500)..(500): n is a, c, g, or t
  modified_base (551)..(551): a, c, t, g, unknown or other
  misc_feature (551)..(551): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtgcaacacgggcttgcccagaagttccaaggcagagtagtatgaccaggagcacctccccaggtacagtctacatggaactgagcagcctgagatctgacggacgacggccgtgttatttcgngtgcgagacgccaccgagcaccgtggcttggacgttggtcggggacccaacggggtaaccctgggtaccacccggttctccccgtcgaccggcccttacccgaacccggaaaccgggcccctagttccccggtccctttccccccgnggtccccgtccccgtgcccctccggaaggtccgcccacccgttcccgagcnccgcgttcggccggcccgtggggcctcggccgtcgggttcaaccgg

SEQ ID NO: 350051 - DNA, 587 bp, Homo sapiens
  misc_feature: GZ8MTXP01ATCUT.44.78.H01.1.454.CMB.2.raw
  modified_base (481)..(481): a, c, t, g, unknown or other
  misc_feature (481)..(481): n is a, c, g, or t
  modified_base (552)..(552): a, c, t, g, unknown or other
  misc_feature (552)..(552): n is a, c, g, or t
  modified_base (579)..(579): a, c, t, g, unknown or other
  misc_feature (579)..(579): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaacgccctagtagtggacaacgacgggtctttgcccagaagtccaaggcagagttagtatgaccaggacgccaccctccccgaggtacagtctacagtggaactgagcagcctgagatcgtaggacggaacgacgggtccgttgttatttcgtgtggacgtagacgcccacacgccaccgtggcgtttagacgtttgggcggggccacgggtaaccctgggtcccaccggggttctccgtacncgtccctaccgaccgaacggccctagtcccggtcctccccgtggccctcccgttgccttccgaggccgccnccgcgaagcgcgacgcggccggtccgngggtcccg

SEQ ID NO: 350052 - DNA, 639 bp, Homo sapiens
  misc_feature: GZ8MTXP01DUEJA.44.78.H01.1.454.CMB.2.raw
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaacgtgggtgcgacaggccgctggacaagggctggagtggatgggatggatgaagcctatgtgcaacgacggtcttgcccagaagtcgaaggcagagttagatgacaggagccaccctccccaggtacagtctacagtaggaactgagcagccgtagagtatcgtaggacggaacgacgggtccgtagttactttcgtagtcgacgggtagacgcccacgagcctacgtggacttggtacgttgggtcggggaccgaacggggtaaccctggtacccgaaccggttcctcccgtaccgaccgtcccctaccgaacccgtaccgggacccctaccggtttcccgttccccgttcccccggtcgggaaccccgtcccttcggtcccttaccgacgggccacccgttccgttaccgaacgacgccgtacgccgggttccggcccggttcgggccg

SEQ ID NO: 350053 - DNA, 635 bp, Homo sapiens
  misc_feature: GZ8MTXP01BVIPL.44.78.H01.1.454.CMB.2.raw
  modified_base (366)..(366): a, c, t, g, unknown or other
  misc_feature (366)..(366): n is a, c, g, or t
  modified_base (580)..(580): a, c, t, g, unknown or other
  misc_feature (580)..(580): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggacaacgacgggtctttcgcccaagtaacgtccaaggcagagttagtatggaccaggacgccaccctccccgaggtaccagtactacagtcggaactgacgcagcctgagatcgngacggaaccacgggtccgtgttactttcgtgtgcggagacgcccacgcgcctaccgtggtctttcggacgtttgggtcggggaccacggggtaacccctggtccctaccggtctcccgtcgaccgcccctacccgaccgacgggtcccctagttccccgggtccccttcccccggtgggcccctccccgttcggcccgttaccgacggggcccncccgttacccgccggaagaccggccaacggcggcccgggtcccgttcggggtccc

SEQ ID NO: 350054 - DNA, 701 bp, Homo sapiens
  misc_feature: GZ8MTXP01BL7ST.44.78.H01.1.454.CMB.2.raw
  modified_base (584)..(584): a, c, t, g, unknown or other
  misc_feature (584)..(584): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagcctatagtggcaaacgcggctttgccagtaagtccaaaggcagagttagtatggaccaggagccacccctcccaggtacagtctacatggaactgagcagcctagacgatcgtgacgggaaccaccggggtccgttagttatttccgtggtggaccggagacgcccgacacgctacccgtgggtccttaggaccgtttgggcgggggaccctaacgggggaaccccctttgggtacccgtaacccggggtttccttaacccgtccgtacggaccccggttccccaaacccggaaaccgggggttcccctaaacgtccccggggtttaccctttccccccccggnggggcccctcccccgttaacgggccccttaaccccggagggtaaccccgacccggttacccgaccggtaagcccgaaccgaacggtccgggaccccgggtcccggttcggggtaacc

SEQ ID NO: 350055 - DNA, 595 bp, Homo sapiens
  misc_feature: GZ8MTXP01DLISS.44.78.H01.1.454.CMB.2.raw
  modified_base (452)..(452): a, c, t, g, unknown or other
  misc_feature (452)..(452): n is a, c, g, or t
  modified_base (521)..(521): a, c, t, g, unknown or other
  misc_feature (521)..(521): n is a, c, g, or t
  modified_base (527)..(527): a, c, t, g, unknown or other
  misc_feature (527)..(527): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctagtagtgacaacgacgggtctttcgcccagaacgttccgaaggcaggtagtagtatgaaccgaggacgccaccctccccaggtacagtctacagtaggaactgagcacgcctagacgtatcgtaggaacggaccacgggtcccgttagttactttcgtgtcgacgagacgccaccacgcaccgtgcttggacgttggcgggccaacggggtaccctggccaccgtcncctcgacgccctaccaaccgacggcccagttcccggtcctccccgtgcccgtccctcgcctcgaaggcnccaccncggacgcgaccgcgaccgggcccggcccgttcggggctcgggttaccgtcgggttaacctaaaccggg

SEQ ID NO: 350056 - DNA, 593 bp, Homo sapiens
  misc_feature: GZ8MTXP01ADA1L.44.78.H01.1.454.CMB.2.raw
  modified_base (359)..(359): a, c, t, g, unknown or other
  misc_feature (359)..(359): n is a, c, g, or t
  modified_base (516)..(516): a, c, t, g, unknown or other
  misc_feature (516)..(516): n is a, c, g, or t
  modified_base (540)..(540): a, c, t, g, unknown or other
  misc_feature (540)..(540): n is a, c, g, or t
  modified_base (544)..(544): a, c, t, g, unknown or other
  misc_feature (544)..(544): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctagtagtggacaacgacgggtctttcgcccagaacgtccaaggcagtagttagtatgaccaggacgccaccctcccgaggtacacgtctacataggaactgagcagcctaggagntcgtgacggaaccgacgggccgttgttatttctgtgcgagacgcccacgacgcaccgtggtcttgacgttgggtcgggccgaacgggacctggtccaccggtctccgtcacggccctccgaaccgaccgggcccagttcccggtcccttcccccggngcccgtcccttcggcccttaccgnggcncccgaccgccggaagacgccgtaccgcgggcccggtccgttcgggcccg

SEQ ID NO: 350057 - DNA, 679 bp, Homo sapiens
  misc_feature: GZ8MTXP01AHJQW.44.78.H01.1.454.CMB.2.raw
  modified_base (307)..(307): a, c, t, g, unknown or other
  misc_feature (307)..(307): n is a, c, g, or t
  modified_base (579)..(579): a, c, t, g, unknown or other
  misc_feature (579)..(579): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctgggagtggatgggatggatgaacgccctatagtggacaacgacgggtcttcgcccagaagtccaaggcagagttagatgaccaggacnccaccctccccgaggtacagtctacagtaggaactggacgcgacgcctaggatagtcgtaggaacggaaccgacgggtccgttgttactttcgtggtaggcgtacgacgcccacgaggcctaccgtggtcttcggtacgtttcggggtcggggacccgacggggtaaccccgttgggtaccctacccggggttctaccccgtcgaaccggtcccctacccgaacccggtaaccggggtcccctacggttccccggttcccctttcccccggnggtccccgtacccgttcgtacccgttcccggacgggacccgttcccgacccgttccggaacgaccgccgaccgccgggcccggtcccgttcggggtcccg

SEQ ID NO: 350058 - DNA, 594 bp, Homo sapiens
  misc_feature: GZ8MTXP01B21QL.44.78.H01.1.454.CMB.2.raw
  modified_base (271)..(271): a, c, t, g, unknown or other
  misc_feature (271)..(271): n is a, c, g, or t
  modified_base (345)..(345): a, c, t, g, unknown or other
  misc_feature (345)..(345): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
  modified_base (402)..(402): a, c, t, g, unknown or other
  misc_feature (402)..(402): n is a, c, g, or t
  modified_base (566)..(566): a, c, t, g, unknown or other
  misc_feature (566)..(566): n is a, c, g, or t
tcagacagtatatacacgaccggtgctcgatttagtgtgagtagtttgggtttgggggaagcagcatcggaggtgcctcagccatggcatggatccctctcttcctcggcgtccttgcttactgcacagggtccggggcctcctctgacctgactcagccatcctcactgtcccgtgtcccccaggacacacagtcactattacctgctctggggaaacttgagtgataaattgcttcctggtatcagcagaggccaggccagccccctancgctggtcatctttcaggatataagcggcccctgagggactccctgagcgcttctctgctccactccagggacncggccacgtcncgccntcagcgaccgacccagccctctcggatggaggctagacttnttactgtcgagcggtagggaaggtgtcgttaagttgggtcggttacgggtcgggagggaccgaaggtcgtacgggtcccgttaccggtcggtaacggacgcccgaacgggttcctacccggtcccccgttcgggttcccttaccgttcctcccgtttaaccccnccctcccgttaccttaagttcttaaccg

SEQ ID NO: 350059 - DNA, 786 bp, Homo sapiens
  misc_feature: GZ8MTXP01CP44A.44.78.H01.1.454.CMB.2.raw
  modified_base (421)..(421): a, c, t, g, unknown or other
  misc_feature (421)..(421): n is a, c, g, or t
  modified_base (772)..(772): a, c, t, g, unknown or other
  misc_feature (772)..(772): n is a, c, g, or t
tcagacagtatatacacgaccggtgctcgatttagtgtgagtagtttgggtttgggggcctgggcctcaggaagcagcatcggaggtgcctcagccatggcatggatccctctcttcctcggcgtccttgcttactgcacagggtccgggcctcctctgacctgactcagccatcctcactgtccgtcgtccccaggacacacagtcactattacctgctcgtaggggtaaaacttgagtagaattaaatttgcttccgtggtactcgagcaggacggccaggccacggccccctagtcgtctggtctattctttacgaaggtaataacgtaacgccggtaccctcgacgggtactcccgtgacgtccgtctttccgtaccgtcggtacctaccgtaaacgtccggtaaccgggaaacccnccgggaccctaaccgttcgtacggaacccacgtaccgaaccggcccgacccgaaccccgtacgtcccgttacgtacgggtacttacggggaacgtcgttacggtaaaccctttaagttaccgttacgggttacggaaacgggtaacggggttaacgggtaaacggttcggttaaccgtttaaagggtttcgggggttacggtaccggggtacgggaacgggtaaccgtaaggtcccggttcgggttacccgtttcgggttaccgggtttaaacccgcccggttaaacggttcccgttacccgggtccccccttgggttaacccctcccggttccgttccccggtttccccncccgttttaacccg

SEQ ID NO: 350060 - DNA, 631 bp, Homo sapiens
  misc_feature: GZ8MTXP01BXV1U.44.78.H01.1.454.CMB.2.raw
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaaggctggagtggatgggatggatgaagcctatagtgcaacacgggctttgcccagaagttccaaggcagagtagtatgaccaggagcacctccccaggtacagtctacatggaactgagcagcctgagatcgtgacggacacggccgtgtatttctggtgcgagacgccaccgagcaccgtggtctttaggacgttcgggcgggggtcccgaacgggggtaacccctcgggtccacccggttctcccgtcgacgccccgtacccacccggaaacggggtccccacgttcccggttcccgttcccccgtgggcccgtcccctcggccccttccggaacggaccgccgtaaccccgttcccggaacggacgttcccgaccgacgggcccgggtccccgtggggtcccttcgggcccgttcgggttaaccgtaaaccggg

SEQ ID NO: 350061 - DNA, 649 bp, Homo sapiens
  misc_feature: GZ8MTXP01DYA6K.44.78.H01.1.454.CMB.2.raw
  modified_base (236)..(236): a, c, t, g, unknown or other
  misc_feature (236)..(236): n is a, c, g, or t
  modified_base (263)..(263): a, c, t, g, unknown or other
  misc_feature (263)..(263): n is a, c, g, or t
tcagacagtatatacacgaccggtgctcgatttagtgtgagtagtttgggtttgggggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctgggaaaacttgagtgataaattgcttcngtatcagcagagcaggccagcccctangctggtcaatcttcaggataataaagcggaccctgagggaactcccgtgacgccgtcttccgtcttcggcaccaaactccgtacggggaaacacggcccaacttctacgaaccctaaataccgaacgacccgaccgaacccgacgtccttacgtggtactagggacgtacttaacgtaacttacgttaacgtacgtacgaaggtaacgggttaagggtaaacggttgggtaacgtttaaggtttcggggtacggttacggggacgggaacggtaaccaaacggtcgtacggttaccgttcgtaccggtaacacgaccgacggttccgtacccgtccccgttacgttcttacgttctaccgttccccacctcttacgtaattcgtcg

SEQ ID NO: 350062 - DNA, 587 bp, Homo sapiens
  misc_feature: GZ8MTXP01C9T6E.44.78.H01.1.454.CMB.2.raw
  modified_base (281)..(281): a, c, t, g, unknown or other
  misc_feature (281)..(281): n is a, c, g, or t
  modified_base (331)..(331): a, c, t, g, unknown or other
  misc_feature (331)..(331): n is a, c, g, or t
  modified_base (377)..(377): a, c, t, g, unknown or other
  misc_feature (377)..(377): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacgagggtccgggcctcctctgacctgactcagccatcctcactgtccgtgtccccaggacacacagtcactattacctgctcgtagggaaaacttgagtgaataaatttgcttctggtatcagcagcgcaggccacgcccctancgctggtcatcttacagataagtaagcggcctcgagggtactcctggacnccgtcttcgtccgtcggactacccgtaaactcgtaacgggaaaccncggacctaactctacgaccagtccagccgcgacccagcctcgtaggattgacggtctagactactacgtgtaccgaggtaacgtaggaaagtgtagtaagttgggtacgtcgggcggtaacggaccaaggtctcggaccgttcgcgggtacgacgccccgagttccctccgcccctaacggttccaccttcgtaaccgttcccctaaccc

SEQ ID NO: 350063 - DNA, 726 bp, Homo sapiens
  misc_feature: GZ8MTXP01DABRD.44.78.H01.1.454.CMB.2.raw
  modified_base (623)..(623): a, c, t, g, unknown or other
  misc_feature (623)..(623): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgattattaacgtgggtgcgacgacggccgcgtggaacgaagggctggagtggagtgggatggatagaacgccctagtagtggacaacgacgggtctttcggacccaagtaacgtaccgaaaggcaaggtagttagtactacggaacaggacgccaccctcccgagtacagtctacagtaggactgagcagccgtagagtactcgtacggacggaaaccgtacggtccgttagtttacgtttcgtaggtacgacggacggaccgacccaacgacgccgtacgttgggtacgttgtaaccgggtttggggaccggggaccctaaaccggggtaacccgttcgggtaccccgtaccggtttcccctacccgttaccgacccgttacccgaaccccgaacccggaacggtccccctacggtttcccggttccccctttccccgggngggcccctccccgttggacccgttccggaaacggcccgttacccgttcccgacggaacgaaccgcccgaacggccgggccccggtcccggttcggggttcccg

SEQ ID NO: 350064 - DNA, 763 bp, Homo sapiens
  misc_feature: GZ8MTXP01D5KNP.44.78.H01.1.454.CMB.2.raw
  modified_base (238)..(238): a, c, t, g, unknown or other
  misc_feature (238)..(238): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtcgtccccaggacacacagtcactattacctgctcgtaggggaaaacttgagtntaataaatttgcttcctggtatcagcagaggcaggccacgcccctatcgctggtctattctttacaggaataacgtaacgcggacccctcgacgggtactccccgtagacgtccgtctttacctccgtcggtacctacccgtaaacgttccggtaaacggggaaacccgcccggggtacccaaccgttccctaccggaaccctacgtacccgaacgcccggaaccgaaccccgacggtccctacggtaggtaacgttaccggaagggtaccttacggaacttaacgtttaccgtaggttaccgtaagggtaacgggttaagggggtaaacgttcggtaaccgtttaaggtttacgggggtttaggttaccgggggtacggggaacgggggtaacccaaacggggtccgttaaacgggcccggtttcggttaccgggttaccgaacgggaccccggttaacgccgtaaccccgtccccgttaacggtcccgtccgttacccttcccggtttaaccccttaaccccg

SEQ ID NO: 350065 - DNA, 616 bp, Homo sapiens
  misc_feature: GZ8MTXP01B4HE1.44.78.H01.1.454.CMB.2.raw
  modified_base (192)..(192): a, c, t, g, unknown or other
  misc_feature (192)..(192): n is a, c, g, or t
  modified_base (233)..(233): a, c, t, g, unknown or other
  misc_feature (233)..(233): n is a, c, g, or t
  modified_base (274)..(274): a, c, t, g, unknown or other
  misc_feature (274)..(274): n is a, c, g, or t
  modified_base (282)..(282): a, c, t, g, unknown or other
  misc_feature (282)..(282): n is a, c, g, or t
  modified_base (523)..(523): a, c, t, g, unknown or other
  misc_feature (523)..(523): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggctttctggatacacgttcatcaattatgaattattaacgtgggtgcgacaggccgntggacaaggctggagtggatgggatggatgaagcctatagngcaacgacgggtctttgccagagttccaaggcagagtagangacaggancacctcccgagtacagtactacagtacgaactgagcacgccgtgagatcgtaggacgaccgaggtcctgtattcgtagtcgcgaagacgaccaccagtacaccgtggtccttaggaacgttgggcgggtaacccgaacggggtaacccctgggtacccacccgttctcccgtactaccgaccccggttaaccgaaccggtaaaccggggccccttaacgtcccggtcccctttcccccggnggccctcccgtccgcccgtcgaacgggaccttcccaaccgcggaacgcgacgcgcggttcccgcccgttgggctcgccttcggaacggtaaac

SEQ ID NO: 350066 - DNA, 672 bp, Homo sapiens
  misc_feature: GZ8MTXP01B7FRL.44.78.H01.1.454.CMB.2.raw
  modified_base (251)..(251): a, c, t, g, unknown or other
  misc_feature (251)..(251): n is a, c, g, or t
  modified_base (359)..(359): a, c, t, g, unknown or other
  misc_feature (359)..(359): n is a, c, g, or t
  modified_base (397)..(397): a, c, t, g, unknown or other
  misc_feature (397)..(397): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgattattaactgggtgcgacaggccgctggacaagggctggagtggatgggatggatgaacgccctatgnggcaacgcgggtcttcgcccagaacgtccaaggcagtagttagtatcgaccaggacgccaccctccccaaggtacagtactacagtggaactgacgcagcctggaagntcgtggacggaacgacgggtccgttagttacgtttcgngtcggacgacgacgacccacgacgccaccgtggtaccttaggacgtttggggaccgggggacccaacggggtacccctcgggtacccacccgggttctcccgtaccacggacccctacccgaaccgaacggggtcccctacggttccccggtccccttcccccggtgggccccgtcccgttcggtccccgttaccggacggaaccgttcccgaaaccccgttcccggaaggcccgaacgacccggacgggcccgggtccccgttgggggtaaccc

SEQ ID NO: 350067 - DNA, 671 bp, Homo sapiens
  misc_feature: GZ8MTXP01EKR4A.44.78.H01.1.454.CMB.2.raw
  modified_base (368)..(368): a, c, t, g, unknown or other
  misc_feature (368)..(368): n is a, c, g, or t
  modified_base (603)..(603): a, c, t, g, unknown or other
  misc_feature (603)..(603): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtgcaacgcgggtcttgcccagaagttccaaggcagagtagtatcgaccaggagccaccctccccaggtacagtctacatggaactgagcagcctagagatcgtggaacggaccgacgggtcccgttagttacgtttcgnggtcggacggtacggacgccccaaccgacgccgtaccgttcgggtctttacggtaccggtttcggggtaccgggggaccccgtaaacgggggttaaccccccttggggtcccctaaccccggttcctacccgttaccgaccggtccccgtacccgaaacccggtaacggggtccccctaggttccccggttcctttcccccggtggccccgtcccctgccctccgaagggacccnccgtacccgacggagcgcgacgccgggcccggtccgtgggcctcggttccgtcgggttaaccgtaacg

SEQ ID NO: 350068 - DNA, 607 bp, Homo sapiens
  misc_feature: GZ8MTXP01APBD9.44.78.H01.1.454.CMB.2.raw
  modified_base (501)..(501): a, c, t, g, unknown or other
  misc_feature (501)..(501): n is a, c, g, or t
  modified_base (533)..(533): a, c, t, g, unknown or other
  misc_feature (533)..(533): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctagtagtggcaacgacgggtctttgcccagaagttccaaggcagagtagtatgaccaggactccacctcccaggtacagtctacatgaactgagcaagcctagagatcgtaggacggaccacgggccgtgtatttcgtgtgacgagacgccacagcacctggcttgacgttgggtcggggcccaacggggtaccctggtcccacccggttctcccgtacacggtcccctacccgaacccggtaacgggccccctagtcccggtccctttcccccgngggcccctccctgccctccggaacggtaaccncccgtaacccgcggaagacgccgacgttccggcccgggcccgtgggcctcggccctggggttaacctaaccggg

SEQ ID NO: 350069 - DNA, 661 bp, Homo sapiens
  misc_feature: GZ8MTXP01CTK0I.44.78.H01.1.454.CMB.2.raw
  modified_base (268)..(268): a, c, t, g, unknown or other
  misc_feature (268)..(268): n is a, c, g, or t
  modified_base (405)..(405): a, c, t, g, unknown or other
  misc_feature (405)..(405): n is a, c, g, or t
  modified_base (428)..(428): a, c, t, g, unknown or other
  misc_feature (428)..(428): n is a, c, g, or t
tcagacagtatatacacgaccggtgctcgatttagtgtgagtagtttgggtttgggggcctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtaggggaaacttgagtgtaattaaatttgcttcctggtatcagcagnggccaggccacgcccctagtcgctggtctattctttacgaaggtaataaacgtaacggccggtacccctcgacgggtactccccgtagacgtcgtcttccgtccgtcggcctacccgaacgtccgtaacgggaaccnccggccctactccgtacgacccntcgacggccgaccgtacccacgtcctacgtaggactcggacggtctacgtaacttacttacgtacggtacggtaaggtacgggtagggaaagtcgtaacgttaggttggggtcgggtcggacgggacgggtaaccaggtcgtacggttaccgttcgaccggtcgacgttcccgacggttccctcccggtaccccgttcggtccctaccgttccctccgttcccccgtaacccg

SEQ ID NO: 350070 - DNA, 584 bp, Homo sapiens
  misc_feature: GZ8MTXP01ADVZK.44.78.H01.1.454.CMB.2.raw
  modified_base (305)..(305): a, c, t, g, unknown or other
  misc_feature (305)..(305): n is a, c, g, or t
  modified_base (488)..(488): a, c, t, g, unknown or other
  misc_feature (488)..(488): n is a, c, g, or t
  modified_base (509)..(509): a, c, t, g, unknown or other
  misc_feature (509)..(509): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggctttgcccagaagttccaaggcagagtagtatgaccaggagcacctcccaggtacagtctanatggaactgagcagcctagagatcgtgacggacacggccgtagtactttcgtagtggcgagacgccacagcaccgtgcttgacgttggcggggccaacggggaaccctgggtaccaccgttcctcctacgaccgccctaccaaccgaaaccggggccccaacgtcccggtccctttcccccgngggccctaccccgttgccccnccgaacggacgaccgaccgaccgacgacgacgacgaccggccggcccgtcggcgtcgccgtcggttaacgtaacg

SEQ ID NO: 350071 - DNA, 656 bp, Homo sapiens
  misc_feature: GZ8MTXP01ALK2L.44.78.H01.1.454.CMB.2.raw
  modified_base (569)..(569): a, c, t, g, unknown or other
  misc_feature (569)..(569): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacgacggcttgccagaagtccaaggcagtagttagtatcgaccgaggacgccaccctcccgaggtacacgtctacagttcggaactgacgcacgcctcgagtatcgtaggacggaaccgaccgggtccgttagttactttcgtgtagcgaacgacgacccaacacggtccaccggttgggtcttacgggacgtttggggaccgggggtacccgtaacgggggtaacccctggggttaccccaccggggttcctcccgtccgaccggtcccctaccgaaccgaaccgggtccctacgttcccggtccctttccccgnggaacccctccttcggaaccttccggaacgtaccggccaaccgttcccggaagcgtccaacgccggttcccgccggttggtaacccg

SEQ ID NO: 350072 - DNA, 663 bp, Homo sapiens
  misc_feature: GZ8MTXP01B57L2.44.78.H01.1.454.CMB.2.raw
  modified_base (317)..(317): a, c, t, g, unknown or other
  misc_feature (317)..(317): n is a, c, g, or t
tcagacagtatatacacgaccggtgctcgatttagtgtgagtagtttgggtttggggggaagaggaagactgacggtcccactcccaggtacagctggtgcattctggggctgaggtgaagaagcctggggcctcagtgacagtctcctgcacggcttctggatacacgttcatcaattatgatattaacgtgggtgcgacgaggccgcgtggacgaagggcgtagggagtggagtgggatggatagaacgcctagtaggtgacaacgacggtcttcgccagtagtacgaaggcagagttagtatcgaacgaggacnccaccctccgagtacagtcacgagtagactgagcacgcctagacgacttcgaggacggaacgacggtcgttagttattcgttgcgacgagaccgaccgacaacgcgaccgtggtcgttgacggtttcgggacggggaccgtacgggtaaccctcgggtacccgtacccggggtctcccgccgtaccgtccccgtacccgaacccgggaacgtccccgtacgttccccggttcccctccccggtcggccccgtcccgcggtccccgacggaaccggccgaccccgttacccggccggaacgtacccggcgaacccggcgggttccccgggccgttccggggtcccgg

SEQ ID NO: 350073 - DNA, 632 bp, Homo sapiens
  misc_feature: GZ8MTXP01DHNB7.44.78.H01.1.454.CMB.2.raw
  modified_base (274)..(274): a, c, t, g, unknown or other
  misc_feature (274)..(274): n is a, c, g, or t
  modified_base (356)..(356): a, c, t, g, unknown or other
  misc_feature (356)..(356): n is a, c, g, or t
  modified_base (390)..(390): a, c, t, g, unknown or other
  misc_feature (390)..(390): n is a, c, g, or t
  modified_base (416)..(416): a, c, t, g, unknown or other
  misc_feature (416)..(416): n is a, c, g, or t
tcagacagtatatacacgaccggtgctcgatttagtgtgagtagtttgggtttgggggaagcagcatcggaggtgcctcagccatggcatggatccctctcttcctcggcgtccttgcttactgcacaggggtccggggcctcctctgacctgactcagccatcctcactgtccgtcgtccccaggacacacagtcactattacctgctctaggggaaaacttgagtgaataaattgcttctggtatcagcagacggccaggccacgcccctancgctggtcatctttcagataagtaagcggccctagagggactcccgtgacgcgtcttctctgctccaactccgacgggaacncggccactcgtagaacccatcacgcgccgacccngccctacgtgactggagctgtaactnttaactgtacaggtaacgtagggtaaacgtggtacgttaaggttggggtaggtttccgggcgggtaaacggggacctaaacgggcttacgggacccggtttcctcgggggttaaccaacggaccccgaaacggggttcctaccggccccccgttcgggttcccaccgttcccgtcctttaacccccgtccccttccttaccttaacttaacttccg

SEQ ID NO: 350074 - DNA, 651 bp, Homo sapiens
  misc_feature: GZ8MTXP01BRV84.44.78.H01.1.454.CMB.2.raw
tcagacagtatatacacgaccggtgctcgatttagtgtgagtagtttgggtttggggggaagaggaagactgacggtcccactcccaagtacagctggtgcagtctggggctgaggtgaagaagcctggggcctcagtgacagtctcctgcacggcttctggatacacgttcatcaattatgatattaacgtgggtgcgacaggccgctggacaagggctggagtggatgggatggatgaacgcctagtagtggacaacgacgggtctttcgacccaagtaacgtccaaaggcaagagttagtatcgaccaggacgccaccctccccgaggtacagtctacgatggaactgagcagcctgagatcgtagacggaaccgacgggtccgtagtttactttcgtgtacggacgagaccgacccacgacgaccacgttggtcgtttagcggtttcgggcggggaccgtaacggggtaacccgtcggtacccgacccggggttcctcccgtacgaccgtccctacccgaaccggaccggccctacgttcccggtcccttcccccgtggccccgtcccgttcgcccgttccgaacggccgttacccgccgttaccggaagccgaaccgaccggacggccggtcccgttcgggtcccg

SEQ ID NO: 350075 - DNA, 647 bp, Homo sapiens
  misc_feature: GZ8MTXP01EGGHY.44.78.H01.1.454.CMB.2.raw
  modified_base (329)..(329): a, c, t, g, unknown or other
  misc_feature (329)..(329): n is a, c, g, or t
  modified_base (547)..(547): a, c, t, g, unknown or other
  misc_feature (547)..(547): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaatttatgattattaacgtgggtgcgacaggccgcgtggacaagggctggagtggatgggatggatgaacgccctatagtgacaacgcggtcttgcccagaagtccaaggcagagttagtatgaccaggacgcacctcccgaggtacagtctanatggaactgagcagcctagagatcgtaggacggaaccacgggtccgttgttaactttcgtgtcgacgagacgcccaacgacggccacgtggtacttacggtacgtttgggcgggggaccaacggggtaacccttgggaccctaaccggggttctacccgttaccgacgttcccaccgaaccggaccgggtaccctcgtcccggttcccctttccccgnggtcccctcccgttcgggcccttaccggaacgggacccgcccttacccgttccggaacgacggcccaacggccgggcccggtccccggttggggtccccg

SEQ ID NO: 350076 - DNA, 607 bp, Homo sapiens
  misc_feature: GZ8MTXP01E08YY.44.78.H01.1.454.CMB.2.raw
  modified_base (355)..(355): a, c, t, g, unknown or other
  misc_feature (355)..(355): n is a, c, g, or t
  modified_base (394)..(394): a, c, t, g, unknown or other
  misc_feature (394)..(394): n is a, c, g, or t
  modified_base (545)..(545): a, c, t, g, unknown or other
  misc_feature (545)..(545): n is a, c, g, or t
  modified_base (565)..(565): a, c, t, g, unknown or other
  misc_feature (565)..(565): n is a, c, g, or t
  modified_base (582)..(582): a, c, t, g, unknown or other
  misc_feature (582)..(582): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgattattaactgggtgcgacaggccgcgtggacaagggctggagtggatgggatggatgaacgcctatagtggacaacgacgggctttgcccaagaacgtcaaggcagagttagatcgaaccaggacgccacccgtccccgaggtacagtactacatggaactgagcagctganatcgtaggacggaaccgacgggtccgtgttacgtttcgnggtcgacggagacgcccaacgacgcctcgtgacctttaggcggtttgggcgggggacccacggggtaaccccttggggtaccctccggttcgttccctcgacgccctaccgaaccgacgggcccctagtcccgttccctccccgaggcccncccgttcgacttccgaggcncccgaccgttcgaagcnccgactcggccggtccgttgggccc

SEQ ID NO: 350077 - DNA, 572 bp, Homo sapiens
  misc_feature: GZ8MTXP01AY33I.44.78.H01.1.454.CMB.2.raw
  modified_base (264)..(264): a, c, t, g, unknown or other
  misc_feature (264)..(264): n is a, c, g, or t
  modified_base (359)..(359): a, c, t, g, unknown or other
  misc_feature (359)..(359): n is a, c, g, or t
  modified_base (370)..(370): a, c, t, g, unknown or other
  misc_feature (370)..(370): n is a, c, g, or t
  modified_base (407)..(407): a, c, t, g, unknown or other
  misc_feature (407)..(407): n is a, c, g, or t
tcagacagtatatacacgaccggtgctcgatttagtgtgagtagtttgggtttgggggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctagggaaacttgagtgataaattgcttctgtatcagcagacgcaggccagcccctangctggtcatcttcagataagtaacgcggccctcgaggactcccgtgacgcgctttctctaggcctaccaactccgtacgggaacacggccactcngcccatcagcnccgaccagtcctctggatggaggctgtaactattacngtacgagacggtaggaagtcgggtacgttaaggttcgggtacggttacgggacggacggaaccgtaacgtcgtcgtaccgtcgtcggaacacggaccgtacggcctccgtcccgttccgttccttacctcctccgtccctaccctccttactaacttaactaacg

SEQ ID NO: 350078 - DNA, 704 bp, Homo sapiens
  misc_feature: GZ8MTXP01DZEDF.44.78.H01.1.454.CMB.2.raw
tcagacagtatatacacgaccggtgctcgatttagtgtgagtagttttgggtttgggtgccgaagttgctggaggtcacggtcaccacgctgctgaggtgaagaagcctggggcctcagtgacagtctcctgcacggcttctggatacacgttcatcaattatgatattaacgtgggtgcgacaggccgctggacgaagggctggagtggatgggatggatgaagcctatagtgacaacgacgggtcttcgacccaagaacgttaccgaaggcaggtagttagtatacggaaccgaaggacgaccaccctaccccgaaggtacagtactaacgagtacggaactgacgcagcctagagtatcgtagacggaccgacggtccgtgttatttcgtgtcggacgagacgacccgaccgacgcctaccgtggtacttggaaccgttgggaccgggaccgaacggggtaccccttgggtacccacccggttcctacccgtacgtacccgccccgtaacccggaacccgggaaccggtccccgtaacggttccccggttcccccttcccccggtcgggcccctccccgttcggacccgtccccgggaagggtacccacccgtaaccccgttcggaaacggaccgacccgttacgaccggggtccccgccccggtgggtcccgtccggaccgttaacggaacgtaacccgg

SEQ ID NO: 350079 - DNA, 637 bp, Homo sapiens
  misc_feature: GZ8MTXP01A7VEF.44.78.H01.1.454.CMB.2.raw
  modified_base (345)..(345): a, c, t, g, unknown or other
  misc_feature (345)..(345): n is a, c, g, or t
  modified_base (382)..(382): a, c, t, g, unknown or other
  misc_feature (382)..(382): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgcggtcttcgccagagtccaaggcagagttagatcgaccaggacgcaccctcccgaggtacagtctacagtggaactgagcagcctganatcgtaggacggaaccacgggtccgtgttactttcgngtcggacgagaccgcccacgacgccaccgtggcttagtacgttgggtccgggaccgacgggtacccctgggtacccctaccgggttccctcccttaccgaccgtcccctacccgaacccggaaccggccccttaacggttccccgttccccgttccccgcgggcccctcccgttcgtcccgttacccggacggacgcccgacccgttccggaacgacgcccgacggaccggccgggtcccgttcggggtaacccg

SEQ ID NO: 350080 - DNA, 652 bp, Homo sapiens
  misc_feature: GZ8MTXP01BR9N8.44.78.H01.1.454.CMB.2.raw
  modified_base (386)..(386): a, c, t, g, unknown or other
  misc_feature (386)..(386): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtaggggaaaacttgagtgataaatttgcttcctggtatcagcagagccaggccacgcccctatcgctggtcattctttcaggtataaactaacggccgtcccgtcgacgggactcccgtgacgtcgtcttctccgtcggtcctaccgtaacgtcgtaacgggaaccnccggcccaccttcgtacgacctactaccgacgcccgccgaccccacgcccttacgtcggaacgttcggacggtcgtagaacttacttaacgtcgtacggaacggtacgggtagggtaaacggttgtaccgttaaggtttgggggttacggttcggggtacgggagggtaccaaggtccgttcggttaccgttcgttcgggtcacggcccgacggttccgtcccgccccgttcgtacccgtcttccgttcccgttcccctaaccccg

SEQ ID NO: 350081 - DNA, 756 bp, Homo sapiens
  misc_feature: GZ8MTXP01AS3SX.44.78.H01.1.454.CMB.2.raw
  modified_base (319)..(319): a, c, t, g, unknown or other
  misc_feature (319)..(319): n is a, c, g, or t
  modified_base (334)..(334): a, c, t, g, unknown or other
  misc_feature (334)..(334): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaacgtgggtgcgacaggccgcgtggacgaagggctggagtggagtgggatggatgaacgtccctagtagtggacaacgacgggtctttcgacccagtaacgtccgaaggcaggagttagtatagaccagacncaccctccgagtacngtactacagtacgaactgacgacacgccttaggagtactacgtggaaacggaaaccgtaacgggtccgtttagtttaactttcgttcggtaggacgacggacgacccacgacgcctaccggttggcgtttaggaccgttttcggggaccggggtaccgaacccggggtaacccgttggttaccccgaccggggttccctacccgtaccgaacccgggtcccctaccccggaaaccggtaacccgggtcccccttaaccggttccccggttccccgttcccccggtcgggtccccgtcccccgttgggtacccccttccggaaacggggaccgttaccccgttaaccccggttccgggaaccggaccggaacccgtaaaccgggacccggggcccggggtccccccgggtttggggtccccgg

SEQ ID NO: 350082 - DNA, 561 bp, Homo sapiens
  misc_feature: GZ8MTXP01EB9GA.44.78.H01.1.454.CMB.2.raw
  modified_base (302)..(302): a, c, t, g, unknown or other
  misc_feature (302)..(302): n is a, c, g, or t
  modified_base (336)..(336): a, c, t, g, unknown or other
  misc_feature (336)..(336): n is a, c, g, or t
  modified_base (380)..(380): a, c, t, g, unknown or other
  misc_feature (380)..(380): n is a, c, g, or t
  modified_base (529)..(529): a, c, t, g, unknown or other
  misc_feature (529)..(529): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaaacacgggcttgcccagaagtccaaaggcagagttagtatgaccagganccacctccccaggtacagtctacatggaactgancagcctgagatcgtgacggaaccacgggccgttgtattttccgngtcgcgagacgcccacagcacgtggcttagacgttggtcggggccagggaaccctgggtccaccgggtctcctcacgcctccgaccgaaggcccagtccggtcccttcccccgtggccctcccgttgccttccgaacggcgccttaccncgaagagccacgacggccggtcccgttgggcc

SEQ ID NO: 350083 - DNA, 325 bp, Homo sapiens
  misc_feature: GZ8MTXP01ETMWL.44.78.H01.1.454.CMB.2.raw
tcagacagtatatacacgaccggtgctcgatttagtgtgagtagtttgggtttgggggaagaggaagactgacggtcccactcccaggtacagctggtgcagtctgggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagtccaaggcagagttagtatgaccaggagcacctccccaggtacagtctacagt

SEQ ID NO: 350084 - DNA, 525 bp, Homo sapiens
  misc_feature: GZ8MTXP02JOOK6.44.78.H01.1.454.CMB.2.raw
  modified_base (511)..(511): a, c, t, g, unknown or other
  misc_feature (511)..(511): n is a, c, g, or t
  modified_base (522)..(522): a, c, t, g, unknown or other
  misc_feature (522)..(522): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagttccaaaggcagagttagatgaccaggagcacctccccaggtacagtctacatggaactgagcagcctgagatctgaggacacggccgtgtatttctgtgcgagagccacagcactggctgactgtgggccagggaaccctggtcaccgtctcctcacgcctccaccaagggccccagtccggtccttcccccgtggcccgccctgcctccgacggacgccaccctccgaagacgcacngccggtcccgnggc

SEQ ID NO: 350085 - DNA, 405 bp, Homo sapiens
  misc_feature: GZ8MTXP02HJLAE.44.78.H01.1.454.CMB.2.raw
  modified_base (402)..(405): a, c, t, g, unknown or other
  misc_feature (402)..(405): n is a, c, g, or t
tcagacagtatatacacgaccggtgctcgatttagtgtgagtagtttgggtttgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaccctggtcaccgtctcctcagcctccaccaagggcccatcggtccttccccctggccgccctgctccaggacgccacctccgagacgcacagcggccctgggctgcctggtcaaggactacttcctatatctgtctgagcggggctgggcaaggcgcatagnnnn

SEQ ID NO: 350086 - DNA, 512 bp, Homo sapiens
  misc_feature: GZ8MTXP02IY6KU.44.78.H01.1.454.CMB.2.raw
tcagacagtatatacacgaccggtgctcgatttagtgtgagtagtttgggtttggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagttccaaaggcagagttagtatgaccaggagcacctccccaggtacagtctacatggaactgagcagcctgagatctgaggacacgccgtgtattctgtgcgagagccacagcacctgctgacttgtgggccagggaccctggtcaccgtctctcagcctccaccaaggcccatccggtcttccccctggccgccctgcctccaggacgccacctccgaagcgcacacgccggccctgggcc

SEQ ID NO: 350087 - DNA, 541 bp, Homo sapiens
  misc_feature: GZ8MTXP02GYH7Z.44.78.H01.1.454.CMB.2.raw
  modified_base (309)..(309): a, c, t, g, unknown or other
  misc_feature (309)..(309): n is a, c, g, or t
  modified_base (351)..(351): a, c, t, g, unknown or other
  misc_feature (351)..(351): n is a, c, g, or t
tcagacagtatatacacgaccggtgctcgatttagtgtgagtagtttgggtttggggcctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactatacctgctctgggaaacttgagtgataaattgcttctggtatcagcagagccaggccagccccctatgctggtcatctttcaggataataagcggccctnagggatccctgagcgcttctcctggctccaactctgggaacncggccactctgaccatcagcgcgacccagcctctggatgagctgactattactgtcaggtacgtgggaaagtgactaagttggggtgtttcggggcggaaggggacccaaaggtcgtcggaacccggtttcgtcgggttacacgcccgaaggcctccgcccccgtcggtcacctcctcggtccctccccc

SEQ ID NO: 350088 - DNA, 552 bp, Homo sapiens
  misc_feature: GZ8MTXP02HEYEP.44.78.H01.1.454.CMB.2.raw
  modified_base (351)..(351): a, c, t, g, unknown or other
  misc_feature (351)..(351): n is a, c, g, or t
  modified_base (384)..(384): a, c, t, g, unknown or other
  misc_feature (384)..(384): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacgggctttgcccagaagttccaaggcagagtagtatgaccaggagcacctccccaggtacagtctacatggaactgagcagcctgagatctgacggaaacggccgtgtatttcngtgcgagagccaccagcacctggcttgacttgnggggccaggggaccctggtccaccgtctcctcacgccctaccgacccgaacgggccccagtcccggtccttcccccgtggcccgccctgcctccgacgggacgccacctcccggagacgccacgcgcccggcccgtggggcctcggccgtcggtccaaacgggtaccc

SEQ ID NO: 350089 - DNA, 548 bp, Homo sapiens
  misc_feature: GZ8MTXP02HVM7B.44.78.H01.1.454.CMB.2.raw
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagttccaaggcagagttagtatgaccaggagcacctccccaggtacagtctacatggaactgagcagcctgagatcgtgacggacacggcgtgtattctgtgcgagacgcccacagcacctggcttgactttggcggggccagggaccctggtccaccgtctcctcacgccctaccaccgaacgggccccagtccggtccttcccccgtggcccgccctgcctcccgaggacgccacccgtcggaacgacgccacgacggccggccccgtggggcctcggccctgggtacaaacgg

SEQ ID NO: 350090 - DNA, 535 bp, Homo sapiens
  misc_feature: GZ8MTXP02I72IO.44.78.H01.1.454.CMB.2.raw
  modified_base (326)..(326): a, c, t, g, unknown or other
  misc_feature (326)..(326): n is a, c, g, or t
  modified_base (383)..(383): a, c, t, g, unknown or other
  misc_feature (383)..(383): n is a, c, g, or t
  modified_base (452)..(452): a, c, t, g, unknown or other
  misc_feature (452)..(452): n is a, c, g, or t
  modified_base (458)..(458): a, c, t, g, unknown or other
  misc_feature (458)..(458): n is a, c, g, or t
  modified_base (474)..(474): a, c, t, g, unknown or other
  misc_feature (474)..(474): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagatgaccaggagcacctccccaggtacagtctacatggaactgagcagcctgagntctgaggacacggcgtgtattctgtgcagacgccaccagcaccgtgcttgacttggngggccaggggaccctggcaccgtctcctcacgccctcaccgaacgggcccagtccggtccttcccccgnggcccnccctgcctcgacggcnccaccgtcgagacgaccacgacggccggtcccgtcgggcctcggccgtacggtaccaacgg

SEQ ID NO: 350091 - DNA, 545 bp, Homo sapiens
  misc_feature: GZ8MTXP02HSADY.44.78.H01.1.454.CMB.2.raw
  modified_base (359)..(359): a, c, t, g, unknown or other
  misc_feature (359)..(359): n is a, c, g, or t
  modified_base (409)..(409): a, c, t, g, unknown or other
  misc_feature (409)..(409): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctgggaaacttgagtgataattgcttcctggtatcagcagaggccaggccagccccctatgctggtcatctttcaggtataataagcggccctcagggactccctgacgcgcttctcctggcctccaactctacgggaacnccgggccactctcgacccatccagcgcacccagccctctggactgaggcngactattactgtcagacgtgggaaagtgacgtaagttgggtgttcgggcggaggggaccaaggctggtaccgttcgtcgggtcacgcccgaaggcctcgtcccccgtcggttccaccttcgtcgttcccctacccc

SEQ ID NO: 350092 - DNA, 513 bp, Homo sapiens
  misc_feature: GZ8MTXP02HUH5K.44.78.H01.1.454.CMB.2.raw
  modified_base (378)..(378): a, c, t, g, unknown or other
  misc_feature (378)..(378): n is a, c, g, or t
  modified_base (402)..(402): a, c, t, g, unknown or other
  misc_feature (402)..(402): n is a, c, g, or t
  modified_base (469)..(469): a, c, t, g, unknown or other
  misc_feature (469)..(469): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagngccacagcacctggcttgacttgnggggccagggaaccctggtcaccgtctcctcagccctcaccaagggcccatcggtctcccctggccncctgctccacggcgcacctcgaagacgcacagccggcctgggcc

SEQ ID NO: 350093 - DNA, 536 bp, Homo sapiens
  misc_feature: GZ8MTXP02JROQC.44.78.H01.1.454.CMB.2.raw
  modified_base (453)..(453): a, c, t, g, unknown or other
  misc_feature (453)..(453): n is a, c, g, or t
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
  modified_base (499)..(500): a, c, t, g, unknown or other
  misc_feature (499)..(500): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (519)..(519): a, c, t, g, unknown or other
  misc_feature (519)..(519): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (534)..(534): a, c, t, g, unknown or other
  misc_feature (534)..(534): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagttccaaggcagagttagtatgaccaggacgcacccgtccccgaggtacagtctacagtggaactgagcagcctagagatcgtaggacggacgacgggccgttgtatttcgtgtgacgagacgccaccgagccacgtgtcttgacgttgggcggggccacgggaccctggccaccgtctccncacgccctaccgacgacggcccagtccggtcctccccgngccnccnncctcgacgccnccncgcgngcncncgcgccgcgngc

SEQ ID NO: 350094 - DNA, 537 bp, Homo sapiens
  misc_feature: GZ8MTXP02GVTF8.44.78.H01.1.454.CMB.2.raw
  modified_base (328)..(328): a, c, t, g, unknown or other
  misc_feature (328)..(328): n is a, c, g, or t
  modified_base (352)..(352): a, c, t, g, unknown or other
  misc_feature (352)..(352): n is a, c, g, or t
  modified_base (386)..(386): a, c, t, g, unknown or other
  misc_feature (386)..(386): n is a, c, g, or t
  modified_base (460)..(460): a, c, t, g, unknown or other
  misc_feature (460)..(460): n is a, c, g, or t
  modified_base (479)..(479): a, c, t, g, unknown or other
  misc_feature (479)..(479): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgaganctgaggacacggccgtgtatttcngtgcgagagccacagcaccgtggcttgacttggnggggccagggaccctggtccaccgtctcctcacgccctccaccgacgggcccagtccggtcctccccgtggccnccctgcctcccagggaccnccacccgtcgacgacgccacgcggtccggcccgtgggcctcggccgtcggtacaacgg

SEQ ID NO: 350095 - DNA, 554 bp, Homo sapiens
  misc_feature: GZ8MTXP02JSXZ1.44.78.H01.1.454.CMB.2.raw
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacggcttgcccagaagttccaaggcagagttagtatgaccaggagcacctccccaggtacagtctacatggaactgagcagcctgagatctgaggacacggccgtgtatttctgtgcgagacgccaccagccactggcttgacttggtcgggccagggaaccctggtccaccgtctcctcacgccctccaccgaacgggcccagtcccggtccttcccccgtgggcccgccccgtgcccgtccgacgggacgccacccgtccggaacgacggccaacgcggtcccggcccgtggggccc

SEQ ID NO: 350096 - DNA, 540 bp, Homo sapiens
  misc_feature: GZ8MTXP02GCK08.44.78.H01.1.454.CMB.2.raw
  modified_base (377)..(377): a, c, t, g, unknown or other
  misc_feature (377)..(377): n is a, c, g, or t
  modified_base (466)..(466): a, c, t, g, unknown or other
  misc_feature (466)..(466): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacggctttgcccagaagttccaaggcagagttagtatgaccaggagcacctccccaggtacagtctacatggaactgagcagcctgagatctgaggacacggccgtgtatttctgtgcgagngccacagcactggctgacttgcggggcagggaccctggtcaccgtctcctcacgcctccaccgacgggcccagtccggtccctccccgnggccgccctggcctccgacggacgccacccgtccggaacgacgaccgaccgacggcccggccccgtggggcccg

SEQ ID NO: 350097 - DNA, 556 bp, Homo sapiens
  misc_feature: GZ8MTXP02J25F9.44.78.H01.1.454.CMB.2.raw
  modified_base (370)..(370): a, c, t, g, unknown or other
  misc_feature (370)..(370): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaaggcagagttagtatgaccaggagcacctccccaggtacagtctacatggaactgagcagcctgagatctgagacacggccgtgtatttcngtgcgagacgcccaccagccacctggcttgacttggtggggccagggaccctgggtccaccgtctccgtcacgccctccacccgaagggccccctagtcccggtccttcccccgtgggcccgtccccgtgcccgtccgacggacgccaacccgtccgaagacgccacgcgcccggtccctggggcc

SEQ ID NO: 350098 - DNA, 563 bp, Homo sapiens
  misc_feature: GZ8MTXP02HGOKA.44.78.H01.1.454.CMB.2.raw
  modified_base (352)..(352): a, c, t, g, unknown or other
  misc_feature (352)..(352): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactatacctgctctgggaaacttgagtgataaattgcttctggtatcagcagaggccaggccagccccctatgctggtcatctttcaggataataagcggcctcagggatccctgagcgcttctcctggcctccaactctgggaacncggccactctgaccatcacgccgcgacccagcctctggatgaggctgactattactgtacagtacgtagggaaagtgacttaagtgggttggttcgggcgggtaagggaccaaaggtctacggtacccgtttcgtcggtacgacgaccccgaaaggtccctccggccccccgtcgggtaccaccgttccgtccggtttaccccctaccccc

SEQ ID NO: 350099 - DNA, 587 bp, Homo sapiens
  misc_feature: GZ8MTXP02FYUUL.44.78.H01.1.454.CMB.2.raw
  modified_base (355)..(355): a, c, t, g, unknown or other
  misc_feature (355)..(355): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctggggaaacttgagtgataaatttgcttctggtatcagcagaggccaggccagccccctatgctggtcatcttcaggataatagcgccctcagggatccctgagcgcttctcctggcctccaactctacgggaacncgggcccaacgtctcgaccatcagcgccgacccagcctctggatgaggctgactattacctgtcaggacgtagggaaaagtgaccttaagttggggtcgtttacggggcggaaggggacccaaaaggtcgtacggtaacccggtttcgtaccgggttcacggaccccgaaagggtccctccggccccccgttacgggtccctaaccttccgtccggtttcccctaacccccg

SEQ ID NO: 350100 - DNA, 538 bp, Homo sapiens
  misc_feature: GZ8MTXP02IZ2E3.44.78.H01.1.454.CMB.2.raw
  modified_base (400)..(400): a, c, t, g, unknown or other
  misc_feature (400)..(400): n is a, c, g, or t
  modified_base (520)..(520): a, c, t, g, unknown or other
  misc_feature (520)..(520): n is a, c, g, or t
tcagacagtatatacacgaccggtgctcgatttagtgtgagtagtttgggtttgggggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctggggaaacttgagtgataaattgcttctggtatcagcagagccaggccagccccctatgctggtcatctttcaggataataagcggccctcagggactccctgacgcgcttctctggctccaactcctgggaacacggccactctgaccatcagccgccgacccagccctctggatgagctgactattacngtcagacggtaggaaagtgacttaagttgggtgttcggacgggagggaccgaagcgtcgtaaccgttcgtcgggtcacggcccaaaggcctcgccccgtcggtccacgtcgtcgttcccnccctcctctactcttacg

SEQ ID NO: 350101 - DNA, 525 bp, Homo sapiens
  misc_feature: GZ8MTXP02JOYUF.44.78.H01.1.454.CMB.2.raw
  modified_base (352)..(352): a, c, t, g, unknown or other
  misc_feature (352)..(352): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttcngtgcgagagccacagcacctgcttgacttgtggggccagggaccctggtcaccgtctcctcagcctccaccaacgggccccatccggtcttcccccgtggccgcccctgcctcccagggacgccacctccgacgacgccacacgccggccctggggctgccctggtcaaacgg

SEQ ID NO: 350102 - DNA, 545 bp, Homo sapiens
  misc_feature: GZ8MTXP02IUOAX.44.78.H01.1.454.CMB.2.raw
  modified_base (488)..(488): a, c, t, g, unknown or other
  misc_feature (488)..(488): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacgggctttgcccagaagttccaaggcagagttagtatgaccaggagcacctccccaggtacagtctacatggaactgagcagcctgagatcgtgacggacacggcgtgtatttctgtgcgagacgccaccagcaccgtgcttgacgttggtcggggcccagggacccctggtccaccgtctcctcacgccctaccaccgaacgggccccatcccggtccttcccccgtggcccgccctgcctccgacggcncacctccgacgcgccacgacggccggcccgtgggcctcgcccgttggacctaaacgg

SEQ ID NO: 350103 - DNA, 538 bp, Homo sapiens
  misc_feature: GZ8MTXP02FTWCI.44.78.H01.1.454.CMB.2.raw
  modified_base (352)..(352): a, c, t, g, unknown or other
  misc_feature (352)..(352): n is a, c, g, or t
  modified_base (383)..(383): a, c, t, g, unknown or other
  misc_feature (383)..(383): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttcngtgcgagagccacagcacctgcttgacttgnggggccagggaccctggtcaccgtctcctcacgcctccaccgaacgggcccagtccggtccttcccccgtggccgcccctgcctccgaggacgccaccctccggacgacgccacgacggccggccccgtgggcctcggccctgggtccaaacggg

SEQ ID NO: 350104 - DNA, 515 bp, Homo sapiens
  misc_feature: GZ8MTXP02HSU5I.44.78.H01.1.454.CMB.2.raw
  modified_base (397)..(397): a, c, t, g, unknown or other
  misc_feature (397)..(397): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (433)..(433): a, c, t, g, unknown or other
  misc_feature (433)..(433): n is a, c, g, or t
  modified_base (459)..(459): a, c, t, g, unknown or other
  misc_feature (459)..(459): n is a, c, g, or t
  modified_base (463)..(463): a, c, t, g, unknown or other
  misc_feature (463)..(463): n is a, c, g, or t
  modified_base (466)..(466): a, c, t, g, unknown or other
  misc_feature (466)..(466): n is a, c, g, or t
  modified_base (471)..(471): a, c, t, g, unknown or other
  misc_feature (471)..(471): n is a, c, g, or t
tcagacagtatatacacgaccggtgctcgatttagtgtgagtagtttgggtttggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacggcttgcccagaagttccaaaggcagatagtatgaccaggagcacctccccaggtacagtctacatggaactgagcagcctgagatctgaggacacggccgtgtatttctgtgcgagagccacagcacctggcttgacttgnggggccaggaacctggtcaccgtctcccncacnccncaccgacgccacgtccgtcctcccgngccnccncgccnccacgacgccaccaccgaacgacgacgacgacgccgccgcggcg

SEQ ID NO: 350105 - DNA, 548 bp, Homo sapiens
  misc_feature: GZ8MTXP02J1UY8.44.78.H01.1.454.CMB.2.raw
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgacggacacggccgtgtatttctgtgcgagacgccacagcacctggcttgacttggtcggggccaggggaactcgtggtcaccgtctccgtcacgcctccaccgaacgggcccatccggtccttcccccgtggcccgccctcgacctccgacggacgccacccgtccggacgacgccacgaacggccggcccgtcggggcctcggcccgttggtaccg

SEQ ID NO: 350106 - DNA, 528 bp, Homo sapiens
  misc_feature: GZ8MTXP02J0OI4.44.78.H01.1.454.CMB.2.raw
  modified_base (352)..(352): a, c, t, g, unknown or other
  misc_feature (352)..(352): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgacggacacggcgtgtatttcngtgcgagagccaccagcacctggcttgacttggtgggccagggaccctggtcaccgtctcctcagcctccaccaagggccccagtccggtccttccccctggccgccctgcctccacggacgccacccccgagacgcacacgccggcccgtggggcctgccctggtccaaggtacc

SEQ ID NO: 350107 - DNA, 744 bp, Homo sapiens
  misc_feature: GZ8MTXP02GOD1Z.44.78.H01.1.454.CMB.2.raw
  modified_base (371)..(371): a, c, t, g, unknown or other
  misc_feature (371)..(371): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtagggaaaacttgagtgataaattgcttctggtatcagcagaggccaggccacgccccctatcgctggtcatcttcaggataagtagccgcctcgagggactcccgtgacgcgcttctccgtcggtcctaccaacttcgtacggggaaaccnccgggcccaactccgtacgacccatccgagcccgaccgacccacgccctcgtggtactcggacgggtcctagtaaccgttaatttaaccgttcggtacgtaaacggtaccggggttaaggggtaaaaacgggttcggtaaaccgtttaaaggtttcggggggttacgggtttaccgggggaccgggggaaacgggggtaaccccgaaaacgggtcccgttaacggggttaaacccccggttttcggtacccggggttaccgaaccgggtacccccggaaaaccggggtcccgttaacccggtccccccccggttacggggtaccccctaacccgttttccccggtaccccggttttcccccggtacccccccg

SEQ ID NO: 350108 - DNA, 517 bp, Homo sapiens
  misc_feature: GZ8MTXP02GLOUX.44.78.H01.1.454.CMB.2.raw
tcagacagtatatacacgaccggtgctcgatttagtgtgagtagtttgggtttggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagttccaaaggcagagttagatgaccaggagcacctccccaggtacagtctacatggaactgagcagcctgagatctgaggacacggccgtgtatttctgtgcgagagccacagcacctggcttgacttgtgggccagggaccctggtcaccgtctcctcagcctccaccaacgggcccatccggtctcccccgtggccgccctgcctccacggacgcaccctcgaagacgcacacgcgccctgggcc

SEQ ID NO: 350109 - DNA, 543 bp, Homo sapiens
  misc_feature: GZ8MTXP02HA5L8.44.78.H01.1.454.CMB.2.raw
  modified_base (505)..(505): a, c, t, g, unknown or other
  misc_feature (505)..(505): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtattctgtgcgagacgccacagcacctggcttgacttggtcggggccaggggaaccctggtccaccgtctcctcacgccctccaccgaacgggccccagtccggtcccttcccccgtggccgcccctgccctccgacggacncccacctcgaacgcgccaacgcgcccggcccgtgggcc

SEQ ID NO: 350110 - DNA, 537 bp, Homo sapiens
  misc_feature: GZ8MTXP02JCNPB.44.78.H01.1.454.CMB.2.raw
  modified_base (353)..(353): a, c, t, g, unknown or other
  misc_feature (353)..(353): n is a, c, g, or t
  modified_base (386)..(386): a, c, t, g, unknown or other
  misc_feature (386)..(386): n is a, c, g, or t
  modified_base (415)..(415): a, c, t, g, unknown or other
  misc_feature (415)..(415): n is a, c, g, or t
  modified_base (464)..(464): a, c, t, g, unknown or other
  misc_feature (464)..(464): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgacggacacggccgtgtatttcngtgcgagagccacagcacctggcttgacttggnggggccaggggaccctgggtccaccgtcncctcacgcctccaccgaacgggcccagtccggtccttcccccgtggccnccctgcctccgacggacgccaccgtccgagacgcacgacggccggccctggggcctggccctggtacaaacgg

SEQ ID NO: 350111 - DNA, 545 bp, Homo sapiens
  misc_feature: GZ8MTXP02ILNBJ.44.78.H01.1.454.CMB.2.raw
  modified_base (308)..(308): a, c, t, g, unknown or other
  misc_feature (308)..(308): n is a, c, g, or t
  modified_base (452)..(452): a, c, t, g, unknown or other
  misc_feature (452)..(452): n is a, c, g, or t
tcagacagtatatacacgaccggtgctcgatttagtgtgagtagtttgggtttggggagctctgggagaggagccccagccttgggattcccaggtgtttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacgcctggatgacctgggtccnccaggctccgagggagggctggagtgggtgccgtatagaaccaagctgacggtggacagcagactacgctgcaccgtgaaagcagattcaccatctacaagagatgattacaaaagatacggtgtctactggacagatgaaacngcctagaacaccgaggacacgacgccgtatagttactgtacgtgggacttggtttcaagttccgggacgaacgggaccctggtccaccgttcc

SEQ ID NO: 350112 - DNA, 561 bp, Homo sapiens
  misc_feature: GZ8MTXP02JC88R.44.78.H01.1.454.CMB.2.raw
  modified_base (524)..(524): a, c, t, g, unknown or other
  misc_feature (524)..(524): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacggctttgcccagaagttccaaggcagagttagtatgaccaggagcacctccccaggtacagtctacatggaactgagcagcctgagatctgaggacacggccgtgtatttctgtgcgagcgccaccagcaccgtggcttgacgttggtcgggggccacggggaaccccttgggtcctaccggtcctccctcacggccctccgacccgaacgggcccctagtcccggtccttcccccgtggcccgcccctgccctcccgagggacccncccaccgtcgaacgcgccacgcgcccggccgtcgggc

SEQ ID NO: 350113 - DNA, 539 bp, Homo sapiens
  misc_feature: GZ8MTXP02FXVJ1.44.78.H01.1.454.CMB.2.raw
  modified_base (467)..(467): a, c, t, g, unknown or other
  misc_feature (467)..(467): n is a, c, g, or t
  modified_base (490)..(490): a, c, t, g, unknown or other
  misc_feature (490)..(490): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacgggctttgcccagaagttccaaggcagagttagtatgaccaggagcacctcccaggtacagtctacatggaactgagcagcctgagatcgtgacgacacggcgtgtattctgtgcgagacgccaccagcacctgcttgacgttggtggggccaggggaccctggtccaccgtctcctcacgccctacccgaccgacgggccccagtcccggtcccttcccccgtggccnccctgcctccgaggcgctacccncgacgcgccacgacggcccgcccgtgggcctcggcctcggtacaaacgg

SEQ ID NO: 350114 - DNA, 558 bp, Homo sapiens
  misc_feature: GZ8MTXP02JFVIX.44.78.H01.1.454.CMB.2.raw
  modified_base (373)..(373): a, c, t, g, unknown or other
  misc_feature (373)..(373): n is a, c, g, or t
  modified_base (490)..(490): a, c, t, g, unknown or other
  misc_feature (490)..(490): n is a, c, g, or t
  modified_base (519)..(519): a, c, t, g, unknown or other
  misc_feature (519)..(519): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagttccaaaggcagagttagtatgaccaggagcacctccccaggtacagtctacatggaactgagcagcctgagatctagaggacacgggccgtgttatttcngtgcgagagccacagcaccgtggcttgacgttggtcggggaccacggggaaccctgggtccaccggtctcctcacgccctaccaccgaacgggccccagtcccggtccttcccccgnggcccgtccctcgccctccgacggacccnccaccgccgaacgacgacgacgcgccggtccgtcggccg

SEQ ID NO: 350115 - DNA, 521 bp, Homo sapiens
  misc_feature: GZ8MTXP02IVSC8.44.78.H01.1.454.CMB.2.raw
  modified_base (373)..(373): a, c, t, g, unknown or other
  misc_feature (373)..(373): n is a, c, g, or t
  modified_base (397)..(397): a, c, t, g, unknown or other
  misc_feature (397)..(397): n is a, c, g, or t
  modified_base (469)..(469): a, c, t, g, unknown or other
  misc_feature (469)..(469): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagatgaccaggagcacctccccaggtacagtctacatggaactgagcagcctgagatctgagcacgccgtgtattctgtgcgagngccacagcacctggcttgacttgngggccaggggaaccctggtcaccgtctctcacgcctccaccaacgggcccagtccggtctcccccgtggccnccctggcctccgacggcgccacctcgaagacgcacagtccggcccgtgggcc

SEQ ID NO: 350116 - DNA, 522 bp, Homo sapiens
  misc_feature: GZ8MTXP02G3HVI.44.78.H01.1.454.CMB.2.raw
  modified_base (388)..(388): a, c, t, g, unknown or other
  misc_feature (388)..(388): n is a, c, g, or t
  modified_base (465)..(465): a, c, t, g, unknown or other
  misc_feature (465)..(465): n is a, c, g, or t
tcagacagtatatacacgaccggtgctcgatttagtgtgagtagtttgggtttggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagttccaaggcagagttagtatgaccaggagcacctccccaggtacagtctacatggaactgagcagcctgagatctgaggacacggccgtgtatttctgtgcgagagccacagcaccnggctgactgtgggccagggaccctggcacgtctcctcacgccctccaccaacgggcccagtccggtccttcccccgnggcccgccctgacctccgacggacgcacctccgaagacgcacacgccgccctgggcc

SEQ ID NO: 350117 - DNA, 551 bp, Homo sapiens
  misc_feature: GZ8MTXP02HHHNP.44.78.H01.1.454.CMB.2.raw
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacgggctttgcccagaagttccaaggcagagttagtatgaccaggagcacctccccaggtacagtctacatggaactgagcagcctgagatctgacggacacggcgtgtattctgtgcgagacgccacagcacctgctgacttggtgggccagggaccctggtccaccgtctcctcacgtccctacccaccgaacgggccccacgtcccgggtcccttcccccgtggcccgtcccccgttgcctcccgaggaccgccacccgtccggacgacgccaaccgcgccggcccgtcgggctcgcccgtggtaccaacgg

SEQ ID NO: 350118 - DNA, 555 bp, Homo sapiens
  misc_feature: GZ8MTXP02INJP6.44.78.H01.1.454.CMB.2.raw
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagttccaaggcagagttagatgaccaggagcacctccccaggtacagtctacatggaactgagcagcctgagatctgaggacacgccgtgtattctgtgcgagacgccacagcaccgtggcttgacgttggtggggccagggaaccctggtccaccgtctcctcacgccctccaccgaacgggcccagtccggtcctcccccgtcggccgtccccttggcccttcccgacgggacgcccgtacctccggaacgacggccaccgaacgcccggcccgtggggcccg

SEQ ID NO: 350119 - DNA, 561 bp, Homo sapiens
  misc_feature: GZ8MTXP02GXEG2.44.78.H01.1.454.CMB.2.raw
  modified_base (309)..(309): a, c, t, g, unknown or other
  misc_feature (309)..(309): n is a, c, g, or t
  modified_base (494)..(494): a, c, t, g, unknown or other
  misc_feature (494)..(494): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagcctgggggagtcccttagactctcctgtgcagcctctggattcactttcagtaacgcctggatgacctgggtccnccaggctccgagggaagggctggagtgggtgccgtatagaaccaaagctgacgtgggacagcagactacgctgcaccgtgaaagcaagatcaccatctacaaagagatgattacaaaaagtataacggtgtactctagcaagatagaacagccaggaacaccgagaccagacgtactactatacngtacgtggggacttggtttacaaggttccgggaccgaacggggtaacccctgggtacccaccgttcc

SEQ ID NO: 350120 - DNA, 628 bp, Homo sapiens
  misc_feature: GZ8MTXP02IJWOK.44.78.H01.1.454.CMB.2.raw
  modified_base (529)..(529): a, c, t, g, unknown or other
  misc_feature (529)..(529): n is a, c, g, or t
  modified_base (573)..(573): a, c, t, g, unknown or other
  misc_feature (573)..(573): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacggcttgcccagaagttccaaggcagagtagtatgaccaggagcacctcccaggtacagtctacatggaactgagcagcctgagatctgagacgacggccgtgttattctagtgcgagacgcccaccagccacgtgggcctttaggacctttgggcgggggacccgtacgggggaaccccttgggtacctacccggttcttcccgtacacccggcccttacccgaaacccgaacggggccccctaacgttcccgggttccctttccccccgngggccccgcccccgttcggaccccttacccgacggggaaccccncccgtacccgtaccggaacgaccgccgaccgccggtcccggtcccggtcgggccg

SEQ ID NO: 350121 - DNA, 637 bp, Homo sapiens
  misc_feature: GZ8MTXP02GGL6C.44.78.H01.1.454.CMB.2.raw
  modified_base (385)..(385): a, c, t, g, unknown or other
  misc_feature (385)..(385): n is a, c, g, or t
tcagacagtatatacacgaccggtgctcgatttagtgtgagtagtttgggtttgggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtgggaaacttgagtgataattgcttctggtatcagcaggagccaggccacgccccctatcgctggtctatctttacgaggtaataagtaacggccggtcccctacgacggggtactcccgtaggacgccgtctttctccgtcggcctaccgaactcgtacgggaacnccgggccactcgtacgaccatccgacgccgacccgacccacgccctgtcggaatcgggaaggtcctagtaacttacgtttacgtcgtacgaggtaaccggtaggggaaaagttcgtaacgtttaaagggtttgggggttacggtttaccggggacggggtaacgggaccgaacggtcgtacggtaccgttcgtcggtcacgacccgaaggtccgtcgcccccgttcgtcgaccctcgtccgttacccctccc

SEQ ID NO: 350122 - DNA, 491 bp, Homo sapiens
  misc_feature: GZ8MTXP02G7H2Y.44.78.H01.1.454.CMB.2.raw
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
  modified_base (405)..(405): a, c, t, g, unknown or other
  misc_feature (405)..(405): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
  modified_base (442)..(442): a, c, t, g, unknown or other
  misc_feature (442)..(442): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (452)..(452): a, c, t, g, unknown or other
  misc_feature (452)..(452): n is a, c, g, or t
  modified_base (455)..(455): a, c, t, g, unknown or other
  misc_feature (455)..(455): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgacggacacgcgtgtatttcgntgcgagngccacagcaccngctgacttgngggcaggacccnggtcacgtcncncngccncacgacggccagtccgtctcccgngcncctncncncgcgcnccncgacgcgcacacgcgccgcgcgcgcgtcgtacgacg

SEQ ID NO: 350123 - DNA, 548 bp, Homo sapiens
  misc_feature: GZ8MTXP02JC7F9.44.78.H01.1.454.CMB.2.raw
  modified_base (353)..(353): a, c, t, g, unknown or other
  misc_feature (353)..(353): n is a, c, g, or t
tcagacagtatatacacgaccggtgctcgatttagtgtgagtagtttgggtttgggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctgggaaacttgagtgataattgcttcctggtatcagcagaggccaggccagccccctatgctggtcatctttcaggataataagcgcctcagggactccctgagcgcttctcctggctccaactcgtagggaacncgggccactctcgaccatcagccgcgacccagcctctggatgaggctgactattactgtcaggtacgtgggaaagtgactaagttggggtgttcgggcgggtagggaccaaggccgtggaccgttcgtacggtcacgacccgaagggcctcggccccccgtcggtccaccttccgtaccgttccccctaaccccg

SEQ ID NO: 350124 - DNA, 542 bp, Homo sapiens
  misc_feature: GZ8MTXP02IQ96Q.44.78.H01.1.454.CMB.2.raw
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagttccaaggcagagttagtatgaccaggagcacctccccaggtacagtctacatggaactgagcagcctgagatctgagacacggccgtgtatttctgtgcgagacgccacagcaccgtggcttgacttggtcggggccagggaaccctggtccaccggtctcctcacgccctaccaccgaacgggcccacgtccggtccttcccccgtggcccgccctgcctccgacggcgccaccctccgaagacgacacgacgccggcccgcggtccg

SEQ ID NO: 350125 - DNA, 564 bp, Homo sapiens
  misc_feature: GZ8MTXP02FO3VA.44.78.H01.1.454.CMB.2.raw
  modified_base (350)..(350): a, c, t, g, unknown or other
  misc_feature (350)..(350): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctgggaaacttgagtgataaattgcttctgtatcagcagaggccaggccagccccctatgctggtcatctttcaggataataagcggcctcagggatccctgacgcgcttctcctggctccaactctggaacncggccactctgaccatcagcgcgacccagcctctgatcgaggctgactatactgtcagacgtgggaaaagtgacgttaaagttggggtagtttcgggcgggaaggggacccgaaaaggcgtacggtaacccgtttccgtcgggttaccacggaccccgtaaaggggcctccggcccccttcggggtccacctccgtccgtttccccgtcccccg

SEQ ID NO: 350126 - DNA, 557 bp, Homo sapiens
  misc_feature: GZ8MTXP02G5226.44.78.H01.1.454.CMB.2.raw
  modified_base (329)..(329): a, c, t, g, unknown or other
  misc_feature (329)..(329): n is a, c, g, or t
  modified_base (351)..(351): a, c, t, g, unknown or other
  misc_feature (351)..(351): n is a, c, g, or t
  modified_base (473)..(473): a, c, t, g, unknown or other
  misc_feature (473)..(473): n is a, c, g, or t
  modified_base (499)..(499): a, c, t, g, unknown or other
  misc_feature (499)..(499): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacgggctttgcccagaagttccaaggcagagttagtatgatcaggagcacctccccaggtacagtctacatggaactgagcagcctgagatcngaggacacggccgtgtatttcngtgcgagacgccacagccacctggcttgacgttggtcggggaccacggggaacccctggtccacccgtctcccgtcacgccctccgaccgaacggggccccacgtccggtcccttcccccgnggcccgccctcgcctaccgagggacnccgaccgtccgacgacgccacgaacggccggcccgtcggggcctcggccgtggtaccg

SEQ ID NO: 350127 - DNA, 519 bp, Homo sapiens
  misc_feature: GZ8MTXP02HKN5Z.44.78.H01.1.454.CMB.2.raw
  modified_base (467)..(467): a, c, t, g, unknown or other
  misc_feature (467)..(467): n is a, c, g, or t
tcagacagtatatacacgaccggtgctcgatttagtgtgagtagtttgggtttgggggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctggggaaacttgagtgataaatttgcttcctggtatcagcagaggccaggccagccccctatgctggtcatcttcaggataataagcggccctcagggatcccctgagcgcttctctggctccaactccgtcgggaacacggccactcctgcccatcacgccgcgaccccagccctcgtggatgaggctgactattactgtcaggacgtagggaaagtgacttaagtgggtgtcggcggagggacaagctgaccgtcgnggtcagccaggctcgcccctcggtcactcgtcgtcccgcctctctatactcg

SEQ ID NO: 350128 - DNA, 531 bp, Homo sapiens
  misc_feature: GZ8MTXP02IL2SK.44.78.H01.1.454.CMB.2.raw
  modified_base (400)..(400): a, c, t, g, unknown or other
  misc_feature (400)..(400): n is a, c, g, or t
  modified_base (470)..(470): a, c, t, g, unknown or other
  misc_feature (470)..(470): n is a, c, g, or t
  modified_base (475)..(475): a, c, t, g, unknown or other
  misc_feature (475)..(475): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacggcttgcccagaagttccaaggcagagttagtatgaccaggagcacctccccaggtacagtctacatggaactgagcagcctgagatctgaggacacggccgtgtatttctgtgcgagagccacagcacctggcttgacttgnggggccaggggaccctggtccaccgtctcctcacgccctccaccgaacgggcccatccggtcctccccgnggccnccctgcctccgacggcgccaccgtccgaagacgacacgacggccggccctggggcc

SEQ ID NO: 350129 - DNA, 528 bp, Homo sapiens
  misc_feature: GZ8MTXP02IOCCJ.44.78.H01.1.454.CMB.2.raw
  modified_base (345)..(345): a, c, t, g, unknown or other
  misc_feature (345)..(345): n is a, c, g, or t
  modified_base (406)..(406): a, c, t, g, unknown or other
  misc_feature (406)..(406): n is a, c, g, or t
  modified_base (439)..(439): a, c, t, g, unknown or other
  misc_feature (439)..(439): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
  modified_base (481)..(481): a, c, t, g, unknown or other
  misc_feature (481)..(481): n is a, c, g, or t
  modified_base (492)..(492): a, c, t, g, unknown or other
  misc_feature (492)..(492): n is a, c, g, or t
  modified_base (498)..(498): a, c, t, g, unknown or other
  misc_feature (498)..(498): n is a, c, g, or t
  modified_base (511)..(511): a, c, t, g, unknown or other
  misc_feature (511)..(511): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggctttgcccagaagttccaaggcagagttagtatgaccaggagcacctccccaggtacagtctacatggaactgagcagcctganatctgaggacacgccgtgtatttcgtgtgcgagacgccacagcactggcttgacctttggnggggaccagggaccctggtccaccgtctcctcngcccctccgacacgggcccagtccgtcctcccngccnccctncctcgacgacncacccncgaagacgccacncgcccggcccgtgggcc

SEQ ID NO: 350130 - DNA, 557 bp, Homo sapiens
  misc_feature: GZ8MTXP02GHRN8.44.78.H01.1.454.CMB.2.raw
  modified_base (308)..(308): a, c, t, g, unknown or other
  misc_feature (308)..(308): n is a, c, g, or t
  modified_base (332)..(332): a, c, t, g, unknown or other
  misc_feature (332)..(332): n is a, c, g, or t
  modified_base (397)..(397): a, c, t, g, unknown or other
  misc_feature (397)..(397): n is a, c, g, or t
  modified_base (408)..(408): a, c, t, g, unknown or other
  misc_feature (408)..(408): n is a, c, g, or t
  modified_base (457)..(457): a, c, t, g, unknown or other
  misc_feature (457)..(457): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggatcccttagactctcctgtgcagcctctggattcactttcagtaacgcctggatgacctgggtccnccgaggcctccgagggaggctggngtgggtgcgtatagaacaagctggacggtggacagcagactacgctgccaccgtagaaacgcagntacaccatcanaagagatagattacgaaaagtgtacgtgtactctgacagataggaaacngacctagaaacaccggagacacacgccgtactattactgtctcgggattcggtttcaacgtttccgggaccgtacgggtaccctggtaccgaccgttccc

SEQ ID NO: 350131 - DNA, 538 bp, Homo sapiens
  misc_feature: GZ8MTXP02GCTVU.44.78.H01.1.454.CMB.2.raw
  modified_base (311)..(311): a, c, t, g, unknown or other
  misc_feature (311)..(311): n is a, c, g, or t
  modified_base (356)..(356): a, c, t, g, unknown or other
  misc_feature (356)..(356): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactatacctgctcgtaggggaaacttgagtgataaattgcttctggtatcagcagaggccaggccagccccctatgctggtcatctttcaggataataagcgcctnagggactccctgagcgcttctcctggctcaactcgtacgggaacncgggccactctcgaccatcagcgccgacccagcctgtggatggagctgactattacctgtacaggacgtagggaaagtgacttaagttgggtgttcgggcggtagggaccaagcgtcgacggttctcgggtcacgacccgaaggcgtccgcccccgtcggtccacgtcgtccgtccctaccc

SEQ ID NO: 350132 - DNA, 584 bp, Homo sapiens
  misc_feature: GZ8MTXP02I9VV2.44.78.H01.1.454.CMB.2.raw
  modified_base (494)..(494): a, c, t, g, unknown or other
  misc_feature (494)..(494): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacgacgggctttgcccagaacgttccaaggcagagttagtatgaccaggagccacctccccaggtacagtctacatggaactgagcagcctgagatcgtgacggacacggcgtgtattcgtgtgcgagacgccaccagccaccgtgtcttggacgttgggtcggggacccaacggggaacccctgggtaccacccggtcctcctaccgacgtccctacccgaaccgtaacgggcccctacgttcccgtcccttcccccgnggcccgccctcgcctcccgaggccgaccacccgtaccgacgacgaccaccgacgcccggcccgtggggcctcggcctcggacgtaaacgg

SEQ ID NO: 350133 - DNA, 553 bp, Homo sapiens
  misc_feature: GZ8MTXP02GEZY3.44.78.H01.1.454.CMB.2.raw
  modified_base (364)..(364): a, c, t, g, unknown or other
  misc_feature (364)..(364): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctggggaaaacttgagtgataaatttgcttcctggtatcagcagaggccaggccagccccctatgctggtcatctttcaggataataagccggccctcgagggatccctgagcgcttctctcggcctaccaactcgtagggaaccncggccaactctacgaccatcagcgccacccagcctctggactgacggctgactattaacgtgtacaaggacgtagggaaagtgacttaagttgggtgttcgggcggagggaccaaggctacggtaccgttctacggtcacgacccgaaggccaacgccccctcggtacctacgtctccgtttcccgccc

SEQ ID NO: 350134 - DNA, 539 bp, Homo sapiens
  misc_feature: GZ8MTXP02ICM6D.44.78.H01.1.454.CMB.2.raw
  modified_base (319)..(319): a, c, t, g, unknown or other
  misc_feature (319)..(319): n is a, c, g, or t
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
  modified_base (445)..(445): a, c, t, g, unknown or other
  misc_feature (445)..(445): n is a, c, g, or t
  modified_base (512)..(512): a, c, t, g, unknown or other
  misc_feature (512)..(512): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctcggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacngtctacatggaactgagcagcctagagatctaggagacgacggtccgtgttatttctgtgcgagcnccacgcncacgtgtcttcgtacgttgggcgggaccgacgtaccgtcgacctccgtctccncgacgtcccaccgaccgacgcctacgtccgtccctcccgcgcctccgcacctcgacgccgcctaccncgaacgcgacacgcgccgccggtgccg

SEQ ID NO: 350135 - DNA, 587 bp, Homo sapiens
  misc_feature: GZ8MTXP02FQ5MM.44.78.H01.1.454.CMB.2.raw
  modified_base (360)..(360): a, c, t, g, unknown or other
  misc_feature (360)..(360): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctgggaaactgagtgataattgcttctgtatcagcagagccaggccacgccccctatgctggtcatctttcgaggtataataagccggcctacgagggactcccgtgacgcgtcttctctcggcctccaactcgtacggaacnccgggccactctcgaccatcagccgccgacccagcctcgtgatggagctagacttattactgtacaggtacggtagggtaaagtgtacgttaaggtttggggtggtttacggggacgggtaacgggaccgtaagtcgtacggtacccggtttcgtaccgggtacacggtaccccgaaggtccctccgtcccccgtcggtccaccgttcctcccgttcccctaccccg

SEQ ID NO: 350136 - DNA, 557 bp, Homo sapiens
  misc_feature: GZ8MTXP02I8BP0.44.78.H01.1.454.CMB.2.raw
  modified_base (325)..(325): a, c, t, g, unknown or other
  misc_feature (325)..(325): n is a, c, g, or t
  modified_base (332)..(332): a, c, t, g, unknown or other
  misc_feature (332)..(332): n is a, c, g, or t
  modified_base (354)..(354): a, c, t, g, unknown or other
  misc_feature (354)..(354): n is a, c, g, or t
tcagacagtatatacacgaccggtgctcgatttagtgtgagtagtttgggtttggggcctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctaggggaaacttgagtgataatttgcttctggtatcagcagaggccaggccagccccctatgctggtcatctttcaggataatagcggcctcagggatccctgancgcttcnctgctccaactcgtagggaacnccgggccaacgtctacgaccatcacgccgaccgacccacgcctctgggatggaacggctagactattaccgtgtcaacggtagtagggtaaagtcgagttaaggttgggtgttcgggaggagggaccgaagtcgtggtaccgttcgtacggtcgacgacccgaagccgtcgccccgtcggtaccacgtcgtccgtccctaccc

SEQ ID NO: 350137 - DNA, 578 bp, Homo sapiens
  misc_feature: GZ8MTXP02JQ6I6.44.78.H01.1.454.CMB.2.raw
  modified_base (353)..(353): a, c, t, g, unknown or other
  misc_feature (353)..(353): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctaggggaaacttgagtgataattgcttctggtatcagcagagccaggccacgcccctatgctggtcatcttcagataatagcgcctcgagggactcctgagcgcttctccgtgctaccaactcgtacgggaacncggccactctgaccatccagccgaccgacccacgcctcgtggatgaggctagactattactgtacaggacgtagggaagtgactaagttgggtcggttcgggacgggtaggacccgaaggtccgtacggtacccgtttcggtacggttaccgaccgacccgaacggtcccgtccggacccccgttcgggtaccctaccgtttccgttacccgttacccctacccc

SEQ ID NO: 350138 - DNA, 545 bp, Homo sapiens
  misc_feature: GZ8MTXP02H51G5.44.78.H01.1.454.CMB.2.raw
  modified_base (205)..(205): a, c, t, g, unknown or other
  misc_feature (205)..(205): n is a, c, g, or t
  modified_base (301)..(301): a, c, t, g, unknown or other
  misc_feature (301)..(301): n is a, c, g, or t
  modified_base (346)..(346): a, c, t, g, unknown or other
  misc_feature (346)..(346): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (521)..(521): a, c, t, g, unknown or other
  misc_feature (521)..(521): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccnctggacaagggctggagtggatggatggatgaagcctatagtggcaacacgggctttgcccagaagttccaaaggcagagttagtatgaccaggancacctcccaggtacagtctacatggaactgagcagcctgagatcngagacacggcctgtattcngtgcgancgccaccagccaccgtggcttgacgttggtcgggccgagggaaccctggtccaccggtctcctcacgcctccgaccgaacgggcccagtcccggtccttcccccgtggcccgccctcgcctccgacgaccgccacccgtccgaacgacnccgacgacgccggcccgtcggccg

SEQ ID NO: 350139 - DNA, 756 bp, Homo sapiens
  misc_feature: GZ8MTXP02JQDFK.44.78.H01.1.454.CMB.2.raw
  modified_base (319)..(319): a, c, t, g, unknown or other
  misc_feature (319)..(319): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctgggagtggagtgggatggatagaacgccctagtaggtcggacaacgacgggtcttcgcccagtaacgtccgaaggcagtagttagtagtcgaccgaggacnccacccctccccgaaggtacacgtctaacagtacggaacgtgacgcgaacgtccgtagagtactcgtaggaacggaccgacgggtccgttagttacttttcgtggtgcgagaccgacccacgacgacctccgtggtccgttagtaccgtttggggaccggggacccgtaaaccggggtaacccgttcgggtacccgtacccggttccttaccccgtcgtaccggtacccctaccccgaaacccgggaaaccggggtccccctaacggtttcccccgggtttacccccgtttccccccggcgggtcccccgtccccgtttacgggcccccttaccggggaacggtaacccgccccgttaacccccgtaccgggaaacggacccggaacccgaaccgtacccgggggcccccggtccccgggtttcggggtacccccgg

SEQ ID NO: 350140 - DNA, 521 bp, Homo sapiens
  misc_feature: GZ8MTXP02G9YM9.44.78.H01.1.454.CMB.2.raw
  modified_base (462)..(462): a, c, t, g, unknown or other
  misc_feature (462)..(462): n is a, c, g, or t
  modified_base (488)..(488): a, c, t, g, unknown or other
  misc_feature (488)..(488): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacggctttgcccagaagttccaaggcagagttagtatgaccaggagcaccctcccaggtacagtctacatggaactgagcagcctgagatctgagacacggccgtgtatttcgtgtgcgagacgccacagcaccgtgctgactggtcgggcacgggacctggcaccgtctctcacgcctccacgacggccagtccgtccttccccgnggccgccctacgcctccgacggaccnccaccgacgaacgcgacacgacgccggcgcggc

SEQ ID NO: 350141 - DNA, 571 bp, Homo sapiens
  misc_feature: GZ8MTXP02IZFSY.44.78.H01.1.454.CMB.2.raw
  modified_base (346)..(346): a, c, t, g, unknown or other
  misc_feature (346)..(346): n is a, c, g, or t
  modified_base (349)..(349): a, c, t, g, unknown or other
  misc_feature (349)..(349): n is a, c, g, or t
  modified_base (371)..(371): a, c, t, g, unknown or other
  misc_feature (371)..(371): n is a, c, g, or t
tcagacagtatatacacgaccggtgctcgatttagtgtgagtagtttgggttgggggtaaggaggaagactgacggtcccacctcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagttccaaggcagagttagtatgaccaggagcaccctcccaggtacagtctcatggaactgacgcagcctgagntcngaggacacggccgtgtatttcngtgacgagacgcccaccagccaccgtggcttgacgttggtcggggccacggggaccctggtcctaccgtcctccctcaccgccctaccgacccgaaccgggcccacgttcccggtcccttcccccgtggccccgtcccctcgccctacccgacggccgcccacccgtaccgaagacgcaccgacgcccggcccgtgggcc

SEQ ID NO: 350142 - DNA, 527 bp, Homo sapiens
  misc_feature: GZ8MTXP02GXFWH.44.78.H01.1.454.CMB.2.raw
  modified_base (455)..(455): a, c, t, g, unknown or other
  misc_feature (455)..(455): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacgggcttgcccagaagttccaaggcagagttagtatgaccaggagcacctccccaggtacagtctacatggaactgagcagcctgagatctgacggacacggcgtgtattctgtgcgagacgccacagcacctgctgactggcgggccagggaccctggtccaccgtctcctcacgccctccaccgaacgggcccagtccggtcctccccgtggcccnccctgcctccgacggcgccacccgtcgacgcgacacgacgccggcccgtcgggctcgccgtcggtacaacgg

SEQ ID NO: 350143 - DNA, 515 bp, Homo sapiens
  misc_feature: GZ8MTXP02IYOY2.44.78.H01.1.454.CMB.2.raw
  modified_base (377)..(377): a, c, t, g, unknown or other
  misc_feature (377)..(377): n is a, c, g, or t
  modified_base (460)..(460): a, c, t, g, unknown or other
  misc_feature (460)..(460): n is a, c, g, or t
  modified_base (500)..(500): a, c, t, g, unknown or other
  misc_feature (500)..(500): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgagacacggccgtgtatttctgtgcgagngccacagcactgcttgacttgtgggccagggacctggtcaccgtctcctcagcctccaccacgggcccatcggtcctccccgngccgccctgcctccacggacgcaccctccgaagacgcacncgccggccctgggcc

SEQ ID NO: 350144 - DNA, 641 bp, Homo sapiens
  misc_feature: GZ8MTXP02JVS3K.44.78.H01.1.454.CMB.2.raw
  modified_base (415)..(415): a, c, t, g, unknown or other
  misc_feature (415)..(415): n is a, c, g, or t
  modified_base (431)..(431): a, c, t, g, unknown or other
  misc_feature (431)..(431): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacgcctggatgacctgggtccgccaggctccgaggggagggctggagtgggtggccgtatagaaccaaagctggacggtggacagcagactacgctgccaccgtgaaacgcagatcaccatcacaagngatgacttacaaaagngttacggtgtacctacgttgacgtaagagtacggaaaacacgaccccgtaggaaaccgaacccggaaaggacctaaacgacggtacccgtacttaacttaccgtggtaccgttagggggtaactttcgggtttaccgtaacggtttcccgggggaacccgtaacgggggtaaacccccgtttcggggtaccccctaaccggtttcccccg

SEQ ID NO: 350145 - DNA, 558 bp, Homo sapiens
  misc_feature: GZ8MTXP02J0K96.44.78.H01.1.454.CMB.2.raw
  modified_base (266)..(266): a, c, t, g, unknown or other
  misc_feature (266)..(266): n is a, c, g, or t
tcagacagtatatacacgaccggtgctcgatttagtgtgagtagtttgggtttgggggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcgacaattccactggccctttaaagtctctatcatggtacncagtggtcccggccgagcccccaaagtcctctttacgacgtcctttcgcggcttcggcagtccctggccgttttcggcctccagttctgccacgcggcctcctgaccatcaccaaactccggcctgaggatgagctgactactttgttgtgcatatttcgattcactcaaatatgtcttcggagtcgggacccgcgtcgagcgtcctgcgttcacgtcccaggcccaacccccatcgtacctacgtcctcgttccccgccccctctaactactactcgtctcgacgcggtcg

SEQ ID NO: 350146 - DNA, 546 bp, Homo sapiens
  misc_feature: GZ8MTXP02H2HSC.44.78.H01.1.454.CMB.2.raw
  modified_base (373)..(373): a, c, t, g, unknown or other
  misc_feature (373)..(373): n is a, c, g, or t
  modified_base (524)..(524): a, c, t, g, unknown or other
  misc_feature (524)..(524): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaaggcagagttagtatgaccaggagcacctccccaggtacagtctacatggaactgagcagcctgagatctagaggacacggccgttgtatttcngtgcgagacgccaccagccactggcttgacttggcggggtccagggaaccctggtcaccgtctcctcacgccctccaccgaacgggcccacgtccggtcctcccccgtcggccgccccgttgccctccgacggacgccaccgtccgaagcncacgacgccggccctcgggccg

SEQ ID NO: 350147 - DNA, 549 bp, Homo sapiens
  misc_feature: GZ8MTXP02I1TQX.44.78.H01.1.454.CMB.2.raw
  modified_base (301)..(301): a, c, t, g, unknown or other
  misc_feature (301)..(301): n is a, c, g, or t
  modified_base (486)..(486): a, c, t, g, unknown or other
  misc_feature (486)..(486): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacggctttgcccagaagttccaaggcagagttagtatgaccaggancacctccccaggtacagtctacatggaactgagcagcctgagatctgaggacacggccgtgtattctgtgcgagacgccacagccaccgtggcttagacttggtcggggaccacggggaccctgggtccaccgtctcctcacgccctacccaccgaacgggccccagtccggtcccttcccccgnggcccgccctgccctccgaacgcgaccgacctcgaacgacgccacgacgccggccgtcggccg

SEQ ID NO: 350148 - DNA, 397 bp, Homo sapiens
  misc_feature: GZ8MTXP02H3WQ5.44.78.H01.1.454.CMB.2.raw
  modified_base (395)..(397): a, c, t, g, unknown or other
  misc_feature (395)..(397): n is a, c, g, or t
tcagacagtatatacacgaccggtgctcgatttagtgtgagtagtttgggtttgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtctccccctggcgccctgctccaggagcaccctccgagagcacagcggccctgggctgcctggtcaaggactacttctatatctgtctgagcgggctggcaaggcgcatagnnn

SEQ ID NO: 350149 - DNA, 592 bp, Homo sapiens
  misc_feature: GZ8MTXP02JRENF.44.78.H01.1.454.CMB.2.raw
  modified_base (464)..(464): a, c, t, g, unknown or other
  misc_feature (464)..(464): n is a, c, g, or t
  modified_base (509)..(509): a, c, t, g, unknown or other
  misc_feature (509)..(509): n is a, c, g, or t
  modified_base (574)..(574): a, c, t, g, unknown or other
  misc_feature (574)..(574): n is a, c, g, or t
tcagacagtatatacacgaccggtgctcgatttagtgtgagtagtttgggtttgggggcctgggcctcaggaagcagcatcggaggtgcctcagccatggcatggatccctctcttcctcggcgtccttgcttactgcacgaggggtccggggcctcctctgacctgactcagccatcctcactgtccgtgtccccaggacacacagtcactattacctgctcgtaggggaaaacttgagtgataaatttgcttctggtatcagcagaggccaggccacgccccctatcgctggtctattctttcgaaggtaataaagtaacgccggtccctacgacggggactcccgtgacgccgtcttctccgtcggctacctaacgtcgtacggggaaccaccggccaactcgtacgaaccactccagccgccgacccacgccctgtcggatgaggcctgacttattacgngtacacggtagagggaaagtcgagttaagttcgggtagttcgggngggagggaccaaggtccgtagtccgttcgtcgtcgacgcccgaacgccgtccgcccctacggtcnccgtcctccgtccctccc

SEQ ID NO: 350150 - DNA, 648 bp, Homo sapiens
  misc_feature: GZ8MTXP02GWI0I.44.78.H01.1.454.CMB.2.raw
tcagacagtatatacacgaccggtgctcgatttagtgtgagtagtttgggtttgggggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctaggggaaacttgagtgataaatttgcttcctgtatcagcagagccaggccagccccctatgctggtcatctttcaggtataataagcggccctgacgggactcccgtgacgcgtcttctcgtggcctccaactccgtaggggaaccaccgggaccacctccgtacgacccatccacggccgacccgaaccctacggccctcgtggggactggagggtctaggtaccttattacctggtaccaggtacggttaagggaaagttgacgttaaaggttggggttacgggttaccggggcgggaacggggaacccgaaaggtccgtcggtaacccgtttcgtcggggttaccacggcccgaaacggtcccgtaccgtccccccgttacggtctaccgtccgttccgttccccctacccgttcccttactaactttaacttaccg

SEQ ID NO: 350151 - DNA, 585 bp, Homo sapiens
  misc_feature: GZ8MTXP02HG774.44.78.H01.1.454.CMB.2.raw
  modified_base (529)..(529): a, c, t, g, unknown or other
  misc_feature (529)..(529): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacgggctttgcccagaagttccaaggcagagttagtatgaccaggagcacctccccaggtacagtctacatggaactgagcagcctgagatcgtgacggacacggccgtgttatttcgtggtgcgagacgcccaccagcaccctgggctttggaccgttgggtcgggggacccaacgggggtacccctgggtacccacccgttctccctacgacgtccctacccgaaccgacggggcccctagtcccggtcccttcccccgtgggccctccccgtaggccctccgagggaccnccaccgcgacgcgaccgacgcggtccgccggtcggctcggccgtaggtacgaacgg

SEQ ID NO: 350152 - DNA, 630 bp, Homo sapiens
  misc_feature: GZ8MTXP02JXY3R.44.78.H01.1.454.CMB.2.raw
  modified_base (271)..(271): a, c, t, g, unknown or other
  misc_feature (271)..(271): n is a, c, g, or t
  modified_base (397)..(397): a, c, t, g, unknown or other
  misc_feature (397)..(397): n is a, c, g, or t
tcagacagtatatacacgaccggtgctcgatttagtgtgagtagtttgggtttgggggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctcgtaggggaaacttgagtgaataaatttgcttctggtatcagcagacgccaggccagcccctangctggtcatcttcaggtataataacgcggccctgagggactcccgtgacgcgtcttctcgtggcctcctaactccgtacgggaacacggccactctagaccatcacgccgccgacccacgcctcgnggatgacggctgaactattacgtgtacaggtacggtaggggaaagttgtacgttaaggttggggttcgggttacggggacgggtacggggaacccgtaaggtccgtacggtacccgtttcgtccgggttaccgaccggcccgaaacgggtcccgttaccgccccccgttcggtaccctaccgttccgttcccgtttcccccgccccttacccttacgttaacctactttaccg

SEQ ID NO: 350153 - DNA, 506 bp, Homo sapiens
  misc_feature: GZ8MTXP02FFPRC.44.78.H01.1.454.CMB.2.raw
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (381)..(381): a, c, t, g, unknown or other
  misc_feature (381)..(381): n is a, c, g, or t
  modified_base (444)..(444): a, c, t, g, unknown or other
  misc_feature (444)..(444): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgacggacacggcgtgtatttcngtgcganagccacagcactgcttgactgngggcaggaccctggcacgtctcctcagcctccacaacgggcccatccggtctccccctggccnccctgctccacggacgcacctccgagacgcacagtcggccctggggctggcctagcaaacgg

SEQ ID NO: 350154 - DNA, 575 bp, Homo sapiens
  misc_feature: GZ8MTXP02HESMM.44.78.H01.1.454.CMB.2.raw
tcagacagtatatacacgaccggtgctcgatttagtgtgagtagtttgggtttgggggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtaggggaaacttgagtgataaatttgcttcctggtatcagcagaggccaggccagccccctatgctggtcattcttcaggataataagcggccctcgagggatccctgagcgcttctctcggctccaactccgtacggggaaccacgggccactctcgaccatcacgccgccgacccacgccctcgtggactggaggcctagactattactgtcagtacgtagggaaagtgacgttaagttgggtggttaccgggacgggtacgggaccaaggcgtacggtaccgttcgtacggtcacggtcccgaaggtcctcgcccccgtcggtccaccgtcgtccgttccccgcccttccgtactactactacg

SEQ ID NO: 350155 - DNA, 540 bp, Homo sapiens
  misc_feature: GZ8MTXP02IOJ28.44.78.H01.1.454.CMB.2.raw
  modified_base (498)..(498): a, c, t, g, unknown or other
  misc_feature (498)..(498): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagttccaaggcagagttagtatgaccaggagcacctccccaggtacagtctacatggaactgagcagcctgagatctgaggacacggccgtgtatttctgtgcgagagccaccagcactggctgactgtcgggccagggaccctggtcaccgtctcctcacgccctaccaccgaacgggccccatccggtcctcccccgtcggcccgcccgtcgcctcccgacggacnccgaccctccgaacgacgccacgacgccggcccgtggggccc

SEQ ID NO: 350156 - DNA, 733 bp, Homo sapiens
  misc_feature: GZ8MTXP02J3MCJ.44.78.H01.1.454.CMB.2.raw
  modified_base (214)..(214): a, c, t, g, unknown or other
  misc_feature (214)..(214): n is a, c, g, or t
  modified_base (348)..(348): a, c, t, g, unknown or other
  misc_feature (348)..(348): n is a, c, g, or t
  modified_base (385)..(385): a, c, t, g, unknown or other
  misc_feature (385)..(385): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattaccngctcgtagggaaacttgagtgataattgcttctgtatcagcagacggccaggcccacgccccctatcgctggtcatctttacgaggataagaacggccggaccctcgagggtactcccgtgacgtccgcttccncctacggtcctcccgaaacgttcgacggggaaacccnccggggcccaaaccttccgtacgaaaccctacgtacccgaaccggcccggacccgttaacccccgaacggtccccgtttaccgggtacggtacgtacggtaccggttaccgtaacgttaaccttaacgttaccgtacggtaaccgaacgggtaacgggttaaggggtaaacggttacggttaacgtttaacggggtttcgggggtacgggttaccgggggaaccgggtaacgggaaccgtacggtccggtacggtacccggttccggtaccgaccgaccgacccggtaccggtcccgtccccggtccccgtcgtacccgtacccgtcccgttccccgtacccctcccg

SEQ ID NO: 350157 - DNA, 536 bp, Homo sapiens
  misc_feature: GZ8MTXP02I069C.44.78.H01.1.454.CMB.2.raw
  modified_base (463)..(463): a, c, t, g, unknown or other
  misc_feature (463)..(463): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctagaggacacggccgtgtattctgtgcgagagccacagcactgctgacttgcgggcaggacctggcaccgtctcctcacgcctccaccgaacggcccagtccggtccttcccccgnggccctccccgtgcccgtccgacggcgacccacccgtccgaagacgccgaacgcggcccggcccgtgggcccg

SEQ ID NO: 350158 - DNA, 677 bp, Homo sapiens
  misc_feature: GZ8MTXP02FWHG8.44.78.H01.1.454.CMB.2.raw
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacgacgggctttgcccagaagttccaaggcagagttagtatgaccaggacgccaccctaccccaggtacagtctacagtaggaactgagcagccgtgagatcgtggacggacgaccgggtccgtgttactttcgtggtcggacgaggacgacccgacctacgccacccgtgggtctttacggacgtttgggcgggggacccgaacgggggtaccccttggggtaccctacccgggttcctcccgttccgaaccgccccttaccccgaaacccggaaaccggggtccccctacgttcccccgggtttcccttccccccggtcgggtccccctcccccgttcggccccttacccggacgggtaccgaccccgtaccccgtaccggaaacgccgaccaccggacgggcccggtcccgtgggcctcggccgttacggacctaaacgg

SEQ ID NO: 350159 - DNA, 534 bp, Homo sapiens
  misc_feature: GZ8MTXP02H41FT.44.78.H01.1.454.CMB.2.raw
  modified_base (425)..(425): a, c, t, g, unknown or other
  misc_feature (425)..(425): n is a, c, g, or t
  modified_base (482)..(482): a, c, t, g, unknown or other
  misc_feature (482)..(482): n is a, c, g, or t
  modified_base (498)..(498): a, c, t, g, unknown or other
  misc_feature (498)..(498): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacggctttgcccagaagttccaaggcagagttagtatgaccaggagcacctcccaggtacagtctacatggaactgagcagcctgagatcagagacacggccgtgttatttctgtgcgagacgcccaccagccaccgtggctttgaccttggtcgggggccagggaaccngggtccaccgtctctcacgccctccacgaacggcccagtccggtctcccccgtgccnccctgcctccgaggcnccaccgtccgaagacgcacacgccggccctggggcc

SEQ ID NO: 350160 - DNA, 574 bp, Homo sapiens
  misc_feature: GZ8MTXP02I4FQS.44.78.H01.1.454.CMB.2.raw
  modified_base (468)..(468): a, c, t, g, unknown or other
  misc_feature (468)..(468): n is a, c, g, or t
  modified_base (507)..(507): a, c, t, g, unknown or other
  misc_feature (507)..(507): n is a, c, g, or t
  modified_base (524)..(524): a, c, t, g, unknown or other
  misc_feature (524)..(524): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggtcttgcccagaacgttccaaggcagagttagatgaccaggagcacctcccgaggtacagtcacagtggaactgagcagcctgagtatcgtggacggacgacggccgtgtacttcgtgtgcgagacgcccacacgcacgtcggtcgttagcgttggtcggggaccgacgggaacccgtggtccacccggtcctcctccgacgttcccncccaacggaccgggaccctacggtcgtccccttccccgnggtccctcccgcgtccnccgaacggcacctcccgacgaacgcgaccacgaggccccgtcgcggtccg

SEQ ID NO: 350161 - DNA, 570 bp, Homo sapiens
  misc_feature: GZ8MTXP02G8K1A.44.78.H01.1.454.CMB.2.raw
  modified_base (355)..(355): a, c, t, g, unknown or other
  misc_feature (355)..(355): n is a, c, g, or t
  modified_base (396)..(396): a, c, t, g, unknown or other
  misc_feature (396)..(396): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtagggaaacttgagtgataaattgcttctggtatcagcagaggccaggccacgccccctatgctggtcatcttcaggataataagcgcctcgagggactccctgacgcgcttctcctgctccaactcgtaggaacncggccactctacgaccatcagccgaccgacccagccctcgnggactggacggctaggactaattactgtacacggtacggtagggaaaagtgtacgttaaaggttcggggtagttcgggcgggtaacgggaccgaaaggtccgtacggtaccgttcgcggtacacgacccgaaggcctccgcccccgtcggcctacgtcctccgtaccctacccc

SEQ ID NO: 350162 - DNA, 583 bp, Homo sapiens
  misc_feature: GZ8MTXP02GHQCF.44.78.H01.1.454.CMB.2.raw
  modified_base (512)..(512): a, c, t, g, unknown or other
  misc_feature (512)..(512): n is a, c, g, or t
  modified_base (540)..(540): a, c, t, g, unknown or other
  misc_feature (540)..(540): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcaccctccccaggtacagtctacatggaactgagcagcctgagatcgtgaggacacggccgtgtatttctgtgcgagacgacccaccagccaccgtggcctttgacgtttgggcggggcccgaacggggaacccctggtcccacccggtcctcctccgacgtcccctacccgaaccgaacgggcccctacgtcccggtcccttcccccgnggccctccccgtggccctccgacggacncccgacccgtcgaacgacgccaaccgcgccggccctgggcccg

SEQ ID NO: 350163 - DNA, 580 bp, Homo sapiens
  misc_feature: GZ8MTXP02G38Y0.44.78.H01.1.454.CMB.2.raw
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgacggacgacggccgtgtatttctgtgcgagacgccaccagcacctggcttggacttgggtcggggcccaggggtacccctggtccacccggtcctcctacgacgccctaccgaccgtaacgggccccagtcccggtccttcccccgtggcccgccctcgcctcccgaacggaccgcctaacccgtccgaacgacgacccaacgacggcccggcccgtcggggcctcggcccgtacgggtacgaaaccgg

SEQ ID NO: 350164 - DNA, 605 bp, Homo sapiens
  misc_feature: GZ8MTXP02J2LQA.44.78.H01.1.454.CMB.2.raw
  modified_base (364)..(364): a, c, t, g, unknown or other
  misc_feature (364)..(364): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctcgtagggaaacttgagtgataattgcttctggtatcagcagaggccaggccagccccctatcgctggtcatctttcaggataataagcgcctcgagggactccctgacgccgtcttctccgtcggctacccaactgtacgggaacncggccactctgaccatcagcgccgacccagccctcgtgacgtgacggtctacggtacttattacgtgtccaggtacgttagggaaagtcgactaaggttgggtaacgttcggggacgggacgggtaacccgaagtccgtacggtacccgttcgtccggtacgaccgtacccgaaacgggccgttaaccggccccccttacggggccctaaccgttcccggttccgttcccccggtcccccg

SEQ ID NO: 350165 - DNA, 743 bp, Homo sapiens
  misc_feature: GZ8MTXP02I1A1K.44.78.H01.1.454.CMB.2.raw
  modified_base (373)..(373): a, c, t, g, unknown or other
  misc_feature (373)..(373): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtagggaaacttgagtgataattgcttctggtatcagcagagccaggccacgccccctatcgctggtcatcttcaggataataagccggccctcgagggactcccgtgacgccgctttctccgtcggcctacccaacgttcgtacggggaaaccnccggggcccaaccttccgtacgaaccctactccgaacggcccgacccggtaaccccacgtaccccgtcgttacgggaacgttcgggaaacggggtcttacgggtaacctttaacgtttaaacccgtcggtttacgaaacggggtaccggggttaaggggtaaaaggttcggtaaccgtttaaagggtttgggggtttcgggtttaccgggggacggggtaaacggggtaacccgtaaacgggtccgttacgggttaaaccccggttcgttacccgggtaccgaccggaccccggtaacgggtcccgtcccggtccccccgttagggttacccctaccgttcccgtttcccggtaccccctttaacccccg

SEQ ID NO: 350166 - DNA, 620 bp, Homo sapiens
  misc_feature: GZ8MTXP02H4OD1.44.78.H01.1.454.CMB.2.raw
  modified_base (362)..(362): a, c, t, g, unknown or other
  misc_feature (362)..(362): n is a, c, g, or t
tcagacagtatatacacgaccggtgctcgatttagtgtgagtagtttgggtttgggggcctgggcctcaggaagcagcatcggaggtgcctcagccatggcatggatccctctcttcctcggcgtccttgcttactgcacaggggtccggggcctcctctgacctgactcagccatcctcactgtccgtgtccccaggacacacagtcactattacctgctctggggaaaacttgagtgataaattgcttcctgtatcagcagaggccaggccagccccctatgctggtcatctttcaggataataagcggcctcgagggactcctgagccgcttctctggcctccaactcgtacgggaacncggccactctcgaccatcacgccgccgacccagccctcgtggaactggacggctaggactaacttactggtccaaggtaccggttaggggaaaagtcggtaacttaaggttcggggttgggttacggggacgggtagggggaacccaaagggtcgtacgggtaccggtttcgtcgggtacctacggacccgtaaagggcccgttaaccggccccccgttacgggtcctaccgttccgttacgtttaccccccaacccg

SEQ ID NO: 350167 - DNA, 546 bp, Homo sapiens
  misc_feature: GZ8MTXP02IX5UY.44.78.H01.1.454.CMB.2.raw
  modified_base (505)..(505): a, c, t, g, unknown or other
  misc_feature (505)..(505): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggcttgcccagaagttccaaggcagagttagtatgaccaggagcacctccccaggtacagtctacatggaactgagcagcctgagatctgagacacggccgtgtattctgtgcgagagcccacagccacctgggcttggacgttggtggggccaggggaaccctgggtccacccggtctcctcacgccctccaccgaaggcccagttccggtcctcccccgtggccgccctgcctccgacggtacnccaccctcggaagcgccacgaggtcccggcccgtcgggtcc

SEQ ID NO: 350168 - DNA, 556 bp, Homo sapiens
  misc_feature: GZ8MTXP02F3Y7P.44.78.H01.1.454.CMB.2.raw
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccacagcacctggcttgacgttggcggggccaggggaaccctgggtccaccgtccgtcctcacgccctacccgaccgaacggggcccctaagtcccgggtccttcccccgtggcccgcccgtgccctaccgacggcgccacccgtccgaacgcgccacgcgtccggccctgggcccg

SEQ ID NO: 350169 - DNA, 655 bp, Homo sapiens
  misc_feature: GZ8MTXP02H7C1C.44.78.H01.1.454.CMB.2.raw
  modified_base (284)..(284): a, c, t, g, unknown or other
  misc_feature (284)..(284): n is a, c, g, or t
  modified_base (360)..(360): a, c, t, g, unknown or other
  misc_feature (360)..(360): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggtctttgcccagtaagtccaaggcagagttagatgacaggancacctccccaggtacagtctacagtaggaactgacgcagcctgagatcgtgacgacgacggtccgtgttatttcgngtcgacggacgacgcccaaccgacgaccaccgtggtccttaggtacgttgggtaccgggggaccctaacgggggtaaccccgtcgggtacccacccggttcctcccgtaccgccgtaccccttcccgaaacccggtaacgggccccctacgttccccgggttccccttccccccgtcgggccccgtccccgtcgccccgtaccggacggaccgcccacccgtccggaacgacccggacctaaccggcggcccgggccctcggggtcctccggcccggtacggtaccgaaaccggg

SEQ ID NO: 350170 - DNA, 554 bp, Homo sapiens
  misc_feature: GZ8MTXP02GVOB1.44.78.H01.1.454.CMB.2.raw
  modified_base (467)..(467): a, c, t, g, unknown or other
  misc_feature (467)..(467): n is a, c, g, or t
  modified_base (477)..(477): a, c, t, g, unknown or other
  misc_feature (477)..(477): n is a, c, g, or t
tcagacagtatatacacgaccggtgctcgatttagtgtgagtagtttgggtttgggggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcgacaattccactggccctttaaagtctctatcatggtacgcagtggtcccggccgagcccccaaagtcctctttacgacgtcctttcgcggcttcggcacgtccctggtccgttttcggcctctagttctgtaccacgcggcctcctcgaccatcaaccaaactccgcctgacggatgagctgactactttgtgtgcattattcgtattcactacaaatatgtcttcggaagtcggaccgngtcagcgtcngctcacgacccacgcccaaccccactcgtcacctctcgttccccgccctcctaactactactactgtctgacgcggg

SEQ ID NO: 350171 - DNA, 619 bp, Homo sapiens
  misc_feature: GZ8MTXP02HKFMF.44.78.H01.1.454.CMB.2.raw
  modified_base (477)..(477): a, c, t, g, unknown or other
  misc_feature (477)..(477): n is a, c, g, or t
  modified_base (530)..(530): a, c, t, g, unknown or other
  misc_feature (530)..(530): n is a, c, g, or t
  modified_base (553)..(553): a, c, t, g, unknown or other
  misc_feature (553)..(553): n is a, c, g, or t
  modified_base (564)..(564): a, c, t, g, unknown or other
  misc_feature (564)..(564): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggattttccttgctgcttattttaaaaggtgtccagtgtgaggtgcagttggtggagtcgtgggggaggtttggtaaagccgtggggagtcccttagactctcctgtgcagcctctggattctactttcagtaacgcctggatcgaccgtcgggtcccgccgaggcctaccggaggggaacggggcgtaggggaggttggggttcggacccggttaagttaacggaaacccgaaaaggccgtagggaaccgggtaggggaacagacgagactacgctcgaccgaacccggtagaaaacggcaagacttaccaaccatccanaaagagatagaataacgaaaagacttacggtagtctctgacagatacgaaacncgaccagaaacacgagacacganccgtatatacncgtcgtggattggttacaacggttccgggaccacgggaccctggtacccacgtcc

SEQ ID NO: 350172 - DNA, 727 bp, Homo sapiens
  misc_feature: GZ8MTXP02IIIJX.44.78.H01.1.454.CMB.2.raw
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagcctatagtggacaacgacggcttcgccagaagttccaaggcagagttagtatgaccaggagcacctcccaggtacagtctacatgaactgagcagcctagagatctagaggacacgggccggttagttactttcgtggttgacgtaggaccgcccaaaccgacgccaacccgttgggtccctttagggtaaccgtttggggtaccgggggacccgtaaacgggggaacccccttgggggttacccctaacccccgggttctttacccccgtcgtaaccggacccccttaccccgaaacccggtaaaccgggggtccccctaaacggtttcccccggggttccccctttccccccggttacggggcccccggtcccccgtttccgggacccttaccccggaacggggtaacccgcccccgtaacccgttcccgggaaaggaccgacccgaaccggacgggccccgggcccccggtttacggggcccgg

SEQ ID NO: 350173 - DNA, 506 bp, Homo sapiens
  misc_feature: GZ8MTXP02JG8JD.44.78.H01.1.454.CMB.2.raw
  modified_base (352)..(352): a, c, t, g, unknown or other
  misc_feature (352)..(352): n is a, c, g, or t
  modified_base (404)..(404): a, c, t, g, unknown or other
  misc_feature (404)..(404): n is a, c, g, or t
  modified_base (449)..(449): a, c, t, g, unknown or other
  misc_feature (449)..(449): n is a, c, g, or t
  modified_base (463)..(463): a, c, t, g, unknown or other
  misc_feature (463)..(463): n is a, c, g, or t
  modified_base (487)..(487): a, c, t, g, unknown or other
  misc_feature (487)..(487): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgacggacacggcctgtatttcngtgcgagagccacagcacctgcttgactgtgggcaggaccctggtcacgtcncctcacgcctccaccgaagggcccatccggtctccccctggcccncctgctccaggacncacctcgacgcgcacagcggcccngggctcgcctggtcaacgg

SEQ ID NO: 350174 - DNA, 598 bp, Homo sapiens
  misc_feature: GZ8MTXP02GCO0R.44.78.H01.1.454.CMB.2.raw
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagcccacagcaccgtggcttgacttggtcggggccacggggaccctgggtccaccggtctcctcgacgccctaccgaccgaacgggcccctaacgtcccgggttcccttccccccgtgggtcccgcccccgttagcccgttacccgaagggaccgcccgaacccgttcccggaaggaaccggtccaaccgaaccgggcccgggcccccgttgggggtcccg

SEQ ID NO: 350175 - DNA, 596 bp, Homo sapiens
  misc_feature: GZ8MTXP02ICTGO.44.78.H01.1.454.CMB.2.raw
  modified_base (331)..(331): a, c, t, g, unknown or other
  misc_feature (331)..(331): n is a, c, g, or t
  modified_base (482)..(482): a, c, t, g, unknown or other
  misc_feature (482)..(482): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacgacgggtctttgcccagaagttccaaggcagagttagatgaccaggagcacctccccaggtacagtctacatggaactgagcagcctgagatcgngacggacacggtccgtgttatttcgtgtgcgagcgaccaccacgcaccgtgtctgacgtttggcggggacccaggggtaccctggtccaccgtctcctcacgtccctaccgaaccgacgggtccctacgtcccggttccctttcccccggnggcccctcccgtcgacccgtaccggacgggaccgcccgtacccgtccggacgaccgccgtaccgccgggtcccggccgtcggggtcctacggtcccggtacggtaaccgaacgg

SEQ ID NO: 350176 - DNA, 587 bp, Homo sapiens
  misc_feature: GZ8MTXP02FON94.44.78.H01.1.454.CMB.2.raw
  modified_base (359)..(359): a, c, t, g, unknown or other
  misc_feature (359)..(359): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctgggaaacttgagtgataaatttgcttctggtatcagcagaggccaggccagccccctatgctggtcatcttcaggataataagcggccctcagggactcccgtgagcgcttctcctggcctactaactcgtagggaacnccgggccactctcgacctatcacgccgccgaaccccagccctcgtggactggaggctgactattaactgtacgaggacgtaggggaaaagttgacgttaaagtttgggggtcggttcgggacggggaacggggaccgaaaggccgttcggtaccggtttcgtccgggtacaccggcccgaaacggcctccgcccccgtcggtccaccgttcctccgttccccgtcccc

SEQ ID NO: 350177 - DNA, 664 bp, Homo sapiens
  misc_feature: GZ8MTXP02JL8AI.44.78.H01.1.454.CMB.2.raw
  modified_base (329)..(329): a, c, t, g, unknown or other
  misc_feature (329)..(329): n is a, c, g, or t
  modified_base (522)..(522): a, c, t, g, unknown or other
  misc_feature (522)..(522): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacgggctttgcccagaagttccaaggcagagttagtatgaccaggactccacctccccaggtacagtctacataggaactgagcagcctgagntcgtggacggacgacggccgtgttatttcgtgtgcgagacgccacgacgccaccgtggctttagaccgtttgggcggggacccgtaacggggaaccccgttgggtaccccaccggttcctcccgtacgaccgtcccctaaccccgaacccgtaacgggccccctaacgttcccgggtccccctttcccccggnggtccccgccccgttaggccccttacccggaacggggaccgaccccgtacccgtccgggaaacggaccgacccgaaccgcggggcccgggtcccccggtgggggtccctccgggccccgttacgggggtacctaaaaccggg

SEQ ID NO: 350178 - DNA, 566 bp, Homo sapiens
  misc_feature: GZ8MTXP02H27OB.44.78.H01.1.454.CMB.2.raw
  modified_base (352)..(352): a, c, t, g, unknown or other
  misc_feature (352)..(352): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctcgtgggaaacttgagtgataattgcttctgtatcagcagagccaggccacgcccctatgctggtcatcttcaggataatagcggccctcagggactcccgtgagcgcttctcctggcctcaactctagggaacncggccactctacgaccatcagcgccgacccagcctctggatggagctgactattacgtgtacgaggtacgtaggggaaagtgacgttaagttggggttagttcggggacgggagggtaccaaggtctacggtaccgttcgtaccggtacacggccccgtaagccgtccggtcccccgtcggtccctaccgttccgttcccgttaccccctaccc

SEQ ID NO: 350179 - DNA, 528 bp, Homo sapiens
  misc_feature: GZ8MTXP02FFP00.44.78.H01.1.454.CMB.2.raw
  modified_base (347)..(347): a, c, t, g, unknown or other
  misc_feature (347)..(347): n is a, c, g, or t
  modified_base (363)..(363): a, c, t, g, unknown or other
  misc_feature (363)..(363): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaaggctggagtggatgggatggatgaagccctatagtggcaacacgggctttgcccagaagttccaaggcagagtagtatgaccaggagcacctccccaggtacagtctacatggaactgagcagcctgagatctgaggacacggctgtattcngtgcgagaaccaccancacctggcttgacttgtggggccagggaccctggtcaccgtctcctcagccctccaccaagggcccagtcggtcccttcccccgtggccgccctgcctccacgggacgccacctccgagacgccacacgccggccctggggctcgcccgtcggtacaacggtacc

SEQ ID NO: 350180 - DNA, 578 bp, Homo sapiens
  misc_feature: GZ8MTXP02GJU1U.44.78.H01.1.454.CMB.2.raw
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggctttgcccagaagttccaaggcagagttagtatgaccaggagcacactccccaggtacagtctacatagaactgagcagcccctgagatctggacggacacgggccgttgtactttcgtgtgcgagacgcccacagcaccgtggcttggtacttgggtggggcccgaacggggaacccgtggtcctaccggtccttccctcgacgtcccctaccgacccaacgggccctagtcccgtcccttcccccgtcggcccgccctcgcctccgacggacgcccacccgtccggacgcgaccaccgacggcccggccgtcggg

SEQ ID NO: 350181 - DNA, 541 bp, Homo sapiens
  misc_feature: GZ8MTXP02F3Y09.44.78.H01.1.454.CMB.2.raw
  modified_base (309)..(309): a, c, t, g, unknown or other
  misc_feature (309)..(309): n is a, c, g, or t
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
  modified_base (448)..(448): a, c, t, g, unknown or other
  misc_feature (448)..(448): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacgcctggatgacctgggtccnccaggctccgagggaggctggagtgggtgcgtatagaaccaagctaggacggtggacagcagactacgctgcaccgtagaaagcagatcacatcacaagagatgattacaaaagntacgtntactctgcagatagaacngcctagaacacgagacactacgccgtctatactgtcgtgggtatcggtttacaagtttccgggactacggggaccctgggtaccaccggttcc

SEQ ID NO: 350182 - DNA, 619 bp, Homo sapiens
  misc_feature: GZ8MTXP02G9AR4.44.78.H01.1.454.CMB.2.raw
  modified_base (385)..(385): a, c, t, g, unknown or other
  misc_feature (385)..(385): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacgagggtccgggcctcctctgacctgactcagccatcctcactgtccgtgtccccaggacacacagtcactattacctgctcgtagggaaacttgagtgaattaattgcttctggtatcagcagaggccaggccacgccccctatcgctggtcattctttcgaggtaataaagtaacggccggccctcgacggggtactcccgtagacgtccgtctttctccgtggcctccaacttcgtacgggaacnccgggccactcgtcgaccatcacgccgccgaacccagccctgtggatcggacggtctgaccttattactgtacgaggtacggtagggaaagttgacgttaagttggggtacggttcgggacgggtaacggaccgaaggtcgttaacggtccgttcgtcgggtacaccggacccgaacggtccgtccgcccccgttcggtaccctaccgttcccgttcccgttccccgtcccccg

SEQ ID NO: 350183 - DNA, 596 bp, Homo sapiens
  misc_feature: GZ8MTXP02HJ743.44.78.H01.1.454.CMB.2.raw
  modified_base (377)..(377): a, c, t, g, unknown or other
  misc_feature (377)..(377): n is a, c, g, or t
  modified_base (509)..(509): a, c, t, g, unknown or other
  misc_feature (509)..(509): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctaggggaaacttgagtgaataaatttgcttctggtatcagcagaggccaggccacgcccctatcgctggtcatctttcaggataataagcggccctcgagggtactcccgtgacgccgtcttctccgtcggcctaccaaacttcgtacggggaaaccnccgggccctaactccgtacgacccaatccacggccgcccgaccccagccctcgtaggactggacggctcgaaccttattaccgtgtaccgaggtacggtagggaaagtgacttaaggttggggtgttcgggnggtacgggactaagcgtaggaccgttcgtcggtcgacgcccgaaggcctcggcccccgtcggtccaccgtctccgttacccctaccc

SEQ ID NO: 350184 - DNA, 617 bp, Homo sapiens
  misc_feature: GZ8MTXP02F5KIV.44.78.H01.1.454.CMB.2.raw
tcagacagtatatacacgaccggtgctcgatttagtgtgagtagtttgggtttgggggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctggggaaaacttgagtgataaatttgcttctggtatcagcagaggccaggccagccccctatgctggtcatcttcaggataataagcggccctcgagggactcccgtgagcgtcttctctgctccaactccgtagggaccacggccactctcgccatcagccgccgacccaggccctcgtggactggacggctgactacttacgtgtaccagtacggtagggaaagttggacgttaaggttggggtacgggtttcgggacggggtaaggggacccgtaaaggtccgttacggtaacccgtttcgtaccgggttaccgacggaccccgaacgggccctccggcccccccgttcgggtccctaccgttccgttcccggttcccccgcccttaccctcttactactttaccg

SEQ ID NO: 350185 - DNA, 544 bp, Homo sapiens
  misc_feature: GZ8MTXP02F6C2L.44.78.H01.1.454.CMB.2.raw
  modified_base (381)..(381): a, c, t, g, unknown or other
  misc_feature (381)..(381): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggctttgcccagaagttccaaggcagagttagtatgaccaggagcacctccccaggtaccagtctacatggaactgagcagcctgagatctgaggacacggccgtgtatttctgtgcgagcnccacagcaccgtggcttgacttggtggggccacgggacctggtacaccgtctcctcacgccctacccaccgaacggcccacgtccgtccttcccccgtggcccgccctcgcctcccgacgacgcccacccgtcgaacgcgcacgacggccggcccgtggtccg

SEQ ID NO: 350186 - DNA, 520 bp, Homo sapiens
  misc_feature: GZ8MTXP02JOEIR.44.78.H01.1.454.CMB.2.raw
  modified_base (301)..(301): a, c, t, g, unknown or other
  misc_feature (301)..(301): n is a, c, g, or t
  modified_base (507)..(507): a, c, t, g, unknown or other
  misc_feature (507)..(507): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagtagtatgaccaggancacctccccaggtacagtctacatggaactgagcagcctgagatctgagacacggccgtgtatttctgtgcgagacgccacagcacctggcttgacttggtgggccacgggacctggtccacgtctcctcacgccctccaccgaacgggcccagtccggtcctcccccgtgccgccctgcctcgacggcgcacctcgaagcgcacngccggcctgggcc

SEQ ID NO: 350187 - DNA, 573 bp, Homo sapiens
  misc_feature: GZ8MTXP02JR0IL.44.78.H01.1.454.CMB.2.raw
  modified_base (566)..(566): a, c, t, g, unknown or other
  misc_feature (566)..(566): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatgtggcaacacgggcttgcccagaagttccaaggcagagttagtatgaccaggacgcacctcccaggtacagtctacagtcgaactgagcagcctgagatcgtagacggacacgggccgtagtatttcgtgtgcgagacgccaccagccaccgtggtcttgacgttggtcggggaccgacggggtaaccctgggtccaccggtctccgtcaacgccctacccgaccgtaacgggcccctagtccggtcccttccccgcggcccgtcccgtgccctcgacggcgccctaccgccggaacgcgaccaccgcggcccggtccgnggtcccg

SEQ ID NO: 350188 - DNA, 631 bp, Homo sapiens
  misc_feature: GZ8MTXP02HRDHX.44.78.H01.1.454.CMB.2.raw
  modified_base (361)..(361): a, c, t, g, unknown or other
  misc_feature (361)..(361): n is a, c, g, or t
tcagacagtatatacacgaccggtgctcgatttagtgtgagtagtttgggtttgggggcctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtaggggaaaacttgagtgattaaattgcttctggtatcagcagaggccaggccacgccccctatgctggtcatctttcaggataatagcgcctgagggactcctgagctcttctccgtgcctcaactcgtacgggaaccnccggccactcctacgaaccacgtacacgccgcccgaaccccacgccctcgtgggactcggaacggtctacggacttaacgttactacgtacgaacggtacggtaggggaaaacgttggtacgtttaaaggttggggttacgggttcgggacggggacgggaaccgaacggtcgtacggtaccggttacgtcgggtaccacggacccgtaacggccgtaacccggtcccccgtcggtcccgtaccgtccgttcccgttacccctacccccg

SEQ ID NO: 350189 - DNA, 550 bp, Homo sapiens
  misc_feature: GZ8MTXP02I5ZFW.44.78.H01.1.454.CMB.2.raw
  modified_base (343)..(343): a, c, t, g, unknown or other
  misc_feature (343)..(343): n is a, c, g, or t
  modified_base (439)..(439): a, c, t, g, unknown or other
  misc_feature (439)..(439): n is a, c, g, or t
  modified_base (490)..(490): a, c, t, g, unknown or other
  misc_feature (490)..(490): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagttccaaggcagagttagatgaccaggagcacctccccaggtacagtctacatggaactgagcagcctgagntctgaggacgacggccgtgtattctgtgcgagacgcccacacgcaccgtggcttgacttggcggggccgacgggaaccctggccaccgtctcctcncgccctccaccgaacgggcccagtccggtcctcccccgtggccctcccgtncccgtccacggtaccgcctacccgtcccgaagccgcgaccgcggcccggccgtcggtccg

SEQ ID NO: 350190 - DNA, 565 bp, Homo sapiens
  misc_feature: GZ8MTXP02JVJ6Y.44.78.H01.1.454.CMB.2.raw
tcagacagtatatacacgaccggtgctcgatttagtgtgagtagtttgggtttgggggcctgggcctcaggaagcagcatcggaggtgcctcagccatggcatggatccctctcttcctcggcgtccttgcttacttcacagggtccggggcctcctctgacctgactcagccatcctcactgtccgtgtccccaggacacacagtcactattacctgctctggggaaaacttgagtgataaattgcttcctggtatcagcagaggccaggccagccccctatgctggtcatctttcaggataataagcggccctcgagggactcccgtgacgcgcttctctcggctccaactcgtgggaaccacgggccactctacgaccatcacgccgccgacccacgccctcgtggactggacggctagacttattacctgtcaggacgtagggaaagtgactaagttgggtgttcgggcggtagggaccaagctacggtaccgttctcggtacacgacccgaaggccgtccgcccccgtcggtccacttcctccgttaccccacccttccc

SEQ ID NO: 350191 - DNA, 593 bp, Homo sapiens
  misc_feature: GZ8MTXP02ISM84.44.78.H01.1.454.CMB.2.raw
  modified_base (333)..(333): a, c, t, g, unknown or other
  misc_feature (333)..(333): n is a, c, g, or t
  modified_base (376)..(376): a, c, t, g, unknown or other
  misc_feature (376)..(376): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagttccaaggcagagttagtatgaccaggagcacctccccaggtacagtctacatggactgancagcctgagatctgagacacggccgtgtatttctgtgcgaganccacagcacctggcttgaccgttggtcggggaccacggggaacccgttgggtccaccggttctcccgtcacggcccctacccgaccgaaacggggccccaacgttcccgggttccttccccccgtcgggtcccgtccccgttcgcccgttcccgacgggaccgacccaacccgtcccggaagacgaccgacgacgcccgggccccgtcggggtcccg

SEQ ID NO: 350192 - DNA, 612 bp, Homo sapiens
  misc_feature: GZ8MTXP02J09GP.44.78.H01.1.454.CMB.2.raw
  modified_base (506)..(506): a, c, t, g, unknown or other
  misc_feature (506)..(506): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagccaccctccccaggtacagtctacatggaactgagcagcctgagatcgtggacggaccgacggccgttagttatttcgtggtgcgagacgccaccagccacccgtggtccttgacccgtttgggtcgggggcccacgggggtaacccctgggtcccacccggttcctccctcgacgccctaccgaccgaacgggccctacgttcccggtcccttacccccgnggccccgccctgaccctacccacgggaaacccacccgtccggaagacgccacgacggtccccgggccgtcggggcctcggtccgtacgggtaccgaaacggtaccc

SEQ ID NO: 350193 - DNA, 578 bp, Homo sapiens
  misc_feature: GZ8MTXP02FG8AB.44.78.H01.1.454.CMB.2.raw
  modified_base (310)..(310): a, c, t, g, unknown or other
  misc_feature (310)..(310): n is a, c, g, or t
  modified_base (414)..(414): a, c, t, g, unknown or other
  misc_feature (414)..(414): n is a, c, g, or t
tcagacagtatatacacgaccggtgctcgatttagtgtgagtagtttgggtttggggagctctgggagaggagccccagccttgggacttcccaggttgttttcattcagtgatcaggactgaacacagaggactcaccatggagtttgggctgagctggatttccttgctgctatttaaaaggtgtccagtgtgaggtgcagttggtggagtctggggggaggtttggtaaagccgtggggagtcccttagactctcctgtgcagcctctggattcactttcagtaaccgcctggatgacctgggtccncaggctccgagggagggctggagtgggttgccgtatagaaccaagctgacggtgggacagcagactacgctgccacccgtagaaagcagacttcaccatcctanaagagatagaattaacaaaaagtgtaacggtgtctctagcaagatagaacagcctagaaaccaccggagacacgacgccgtatattactgttcgtagggtatcggtttacaacggttccgggaccgtaacgggggtaacccctggggtaccctacccggttccc

SEQ ID NO: 350194 - DNA, 554 bp, Homo sapiens
  misc_feature: GZ8MTXP02JMKR4.44.78.H01.1.454.CMB.2.raw
  modified_base (360)..(360): a, c, t, g, unknown or other
  misc_feature (360)..(360): n is a, c, g, or t
tcagacagtatatacacgaccggtgctcgatttagtgtgagtagtttgggtttggggctgggcctcaggaagcagcatcggaggttcctcagccatggcatggatccctctcttcctcggcgtccttgcttactgcacagggtccggggcctcctctgacctgactcagccatcctcactgtccgtgtccccaggacacacagtcactattacctgctctaggggaaacttgagtgattaaattgcttcctggtatcagcagaggccaggccagccccctatgctggtcatctttcaggataataagcggccctcgagggactccctgacgcgtctctctcggctccaactctgggaacncggccactctcgaccatcacgcgccgacccagccctgcggatgaggctagactattactgtcaggacgtagggaaacgtgtacgtaagttggggtgttcgggcggagggaccaagcgttacggaccgtttcgcggtcacgcccgaacggcctccgcccccgtcggtccaccgttcctcgttcccccgccttccc

SEQ ID NO: 350195 - DNA, 537 bp, Homo sapiens
  misc_feature: GZ8MTXP02IC3T1.44.78.H01.1.454.CMB.2.raw
  modified_base (350)..(350): a, c, t, g, unknown or other
  misc_feature (350)..(350): n is a, c, g, or t
  modified_base (386)..(386): a, c, t, g, unknown or other
  misc_feature (386)..(386): n is a, c, g, or t
  modified_base (486)..(486): a, c, t, g, unknown or other
  misc_feature (486)..(486): n is a, c, g, or t
  modified_base (507)..(507): a, c, t, g, unknown or other
  misc_feature (507)..(507): n is a, c, g, or t
  modified_base (512)..(512): a, c, t, g, unknown or other
  misc_feature (512)..(512): n is a, c, g, or t
  modified_base (520)..(520): a, c, t, g, unknown or other
  misc_feature (520)..(520): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgacgatcngacggacacgggccgtgttatttcgtgtgcgagacncccacagtccaccgtggccttgactttggcggggccacggggaaccctggtccaccgtctcctcacgccctccacgacggcccagtccgtccttccccgngccgccctgcctccgaggccncgccncgaacgcncacgcggccgccgcggc

SEQ ID NO: 350196 - DNA, 537 bp, Homo sapiens
  misc_feature: GZ8MTXP02HICQ7.44.78.H01.1.454.CMB.2.raw
  modified_base (370)..(370): a, c, t, g, unknown or other
  misc_feature (370)..(370): n is a, c, g, or t
  modified_base (391)..(391): a, c, t, g, unknown or other
  misc_feature (391)..(391): n is a, c, g, or t
  modified_base (467)..(467): a, c, t, g, unknown or other
  misc_feature (467)..(467): n is a, c, g, or t
  modified_base (522)..(522): a, c, t, g, unknown or other
  misc_feature (522)..(522): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgacgcagcctgacgatctggacgacacggcgtgtatttctgtgcgagacgccaccngcaccgtggcttgacttgggngggccaggggaaccctggtccaccgtctcctcacgtccctccaccgaacgggccctagtccgggtccttcccccgngccgcctcgctcccgaggacgccaccgtacgagcgcaacgcgccggcctcgggcncgccctggtacaacg

SEQ ID NO: 350197 - DNA, 681 bp, Homo sapiens
  misc_feature: GZ8MTXP02JXIDX.44.78.H01.1.454.CMB.2.raw
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggagtgggatggatgaagcctatagtggacaacgacggtcttgcccagaacgttccgaaggcagagttagtatgaccaggagcacctccccaggtacagtctacatggaactgagcagcctgagatcgtgacggacacggctgtattctgtgcgagacgcccacgacgccgaccgtggtctttcgacgttgggtacgggggacccgaacgggggtaaccccgtgggtacccaacccggttccttacccgaccgtaccggcccctaccccgaacccgaaaccggggtcccctacggttcccgggttccccttcccccggtcgggccccgtcccccgttcgacccgttcccgaacggggacccgtcccgtaaccccggtaccgaaggacccgacccgaacccggacggggtcccccggccccgggttcgggggcccgttccggggtccccgtttaacggggtaccctaaaacccgggg

SEQ ID NO: 350198 - DNA, 686 bp, Homo sapiens
  misc_feature: GZ8MTXP02IWM7Q.44.78.H01.1.454.CMB.2.raw
  modified_base (393)..(393): a, c, t, g, unknown or other
  misc_feature (393)..(393): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacaggggtccgggcctcctctgacctgactcagccatcctcactgtccgtgtccccaggacacacagtcacttattacctgctcgtaggggaaacttgagtgaattaattgcttcgtggtatcagcagcgcaggccacgcccctatcgctggtcattcttcgagtataagtaacggccgccctacgacgggtactcccgtggacgtccgtcttccgtccgtcggtccctaccctaaacgttccgtaacggggaaccnccgggaccctactccgtacgaaccctaagtccgaaacgcccggacccaaccccgacggtcccttacgttagggacgttcggaacgggtcctacggtaacttacgttacgtcggttaccgaaggttacgggtaagggtaaagggttcgtaacgtttaacgggttggggttacgggttacggggacggggtaacgggacgaaacggtccgtacggtaccgttcggtccggtaccgaccgacccgtacgccgtcccgcccccgtacgtccgtccgtcccgttccgtcccccgtccc

SEQ ID NO: 350199 - DNA, 549 bp, Homo sapiens
  misc_feature: GZ8MTXP02F2EVJ.44.78.H01.1.454.CMB.2.raw
  modified_base (343)..(343): a, c, t, g, unknown or other
  misc_feature (343)..(343): n is a, c, g, or t
  modified_base (369)..(369): a, c, t, g, unknown or other
  misc_feature (369)..(369): n is a, c, g, or t
  modified_base (377)..(377): a, c, t, g, unknown or other
  misc_feature (377)..(377): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagttccaaaggcagagttagatgaccaggagcacctccccaggtacagtctacatggactgagcagcctgagntctgaggacacgggccgtgtatttcngtgcgagngccacagcacctggcttgacttgtcggggcaggaccctggtccaccgtctcctcacgccctaccacgaacgggcccctaagtccgttcctcccccgtcggccgtcccgtcgcctccgacggacgcccgaccctcccggaagaccgacgacacggccggtcccgtggggtccc

SEQ ID NO: 350200 - DNA, 562 bp, Homo sapiens
  misc_feature: GZ8MTXP02FMOI4.44.78.H01.1.454.CMB.2.raw
  modified_base (374)..(374): a, c, t, g, unknown or other
  misc_feature (374)..(374): n is a, c, g, or t
  modified_base (489)..(489): a, c, t, g, unknown or other
  misc_feature (489)..(489): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcaccctccccaggtacagtctacatggaactgagcagcctgagatctggacggacacgggccgtgtatttcngtgcgagcgccacagcaccgtggcttgacttggcggggccaaggggaccctgggtccaccggtctccgtcacgccctcccgaacgacgggccccagtcccggtcctttcccccgnggcccgtcccctggccctccggaacggccgccacccgtccggaagcgacaacgcggcccggcccgtgggcccg

SEQ ID NO: 350201 - DNA, 534 bp, Homo sapiens
  misc_feature: GZ8MTXP02G6ZEJ.44.78.H01.1.454.CMB.2.raw
  modified_base (271)..(271): a, c, t, g, unknown or other
  misc_feature (271)..(271): n is a, c, g, or t
  modified_base (300)..(300): a, c, t, g, unknown or other
  misc_feature (300)..(300): n is a, c, g, or t
  modified_base (337)..(337): a, c, t, g, unknown or other
  misc_feature (337)..(337): n is a, c, g, or t
  modified_base (476)..(476): a, c, t, g, unknown or other
  misc_feature (476)..(476): n is a, c, g, or t
tcagacagtatatacacgaccggtgctcgatttagtgtgagtagtttgggtttgggggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctggggaaaacttgagtgataaatttgcttcctggtatcagcagaggccaggccagccccctangctggtcatcttcaggataatagcgcctnggatccctgagcgcttctctgctccactcctgggacncggcactctgccatcagcgccgacccagcctctggatgaggctgactatactgtcagcgtagggaaagtgacgtaagttgggtgttcggcgggtaggaccaaggtctggtaccgttcgtcggtacacgccgaacggtcnccgcccccgttcggtcctacgtccgtcgttccccgcccttacctaccttacttactcg

SEQ ID NO: 350202 - DNA, 633 bp, Homo sapiens
  misc_feature: GZ8MTXP02FKNG4.44.78.H01.1.454.CMB.2.raw
  modified_base (374)..(374): a, c, t, g, unknown or other
  misc_feature (374)..(374): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctggggaaaacttgagtgataaatttgcttcctggtatcagcagaggccaggccacgccccctatgctggtcatctttcaggataataagcggccctcgagggactcccgtgacgcgtccttctcccgtggtcctccaaactcgtacggggaaccnccgggccactctcgaccatcgagccgcgacccagcctacgtggatggaggctgaccttattacgtgtacgagacggtagggtaaaagtgtacgttaaaggttggggttcggtttacggggacgggaacggggtaaccgaaggtccgttacggtaacccggtttcgtccgggtaccgaccggtaccccgaagggtcccgtaaccggtcccccccgttcgggtaccctacccgtttccgtcccggttacccccgtcccccg

SEQ ID NO: 350203 - DNA, 644 bp, Homo sapiens
  misc_feature: GZ8MTXP02GFRGB.44.78.H01.1.454.CMB.2.raw
  modified_base (375)..(375): a, c, t, g, unknown or other
  misc_feature (375)..(375): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacggctttgcccagaagttccaaggcagagttagtatgaccgaggagccaccctccccgaggtacagtctacatggactgagcagcctgagatcgtgaggacacggccgtgtatttcgngtgcgagacgccaccgagcaccgtggccttagacgttggtcgggggaccacggggtaccctgggtcccaccggttcctccgtcacggtccctacccgaaccgaaccggggcccctaacggttccccggttcccgtttccccccggtgggcccccgtaccccgttcggccccgttacccggaacgggggacccgtacccaccccggttaccccgggaacgaccggaccgaaccccgacggggcccgggtcccccggtagggggtcccccg

SEQ ID NO: 350204 - DNA, 634 bp, Homo sapiens
  misc_feature: GZ8MTXP02G8YI6.44.78.H01.1.454.CMB.2.raw
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacggtcttgccagaagttccaaggcagagttagtatgaccaggancacctcccaggtacagtctacatgaactgacgcagcctgagatctggagacgacggccgtntattctgtgcgagagcccacagccacgtggccttagtacgttcgggtacgggggacccgaacggggtaacccgtcggtacccgtacccggttctcccgttccgacggtcccctaccccgaaccggaaaccggggcccctaacggttcccggttccccgttccccccgtcggcccgtcccccgttcggaccccgttccgaacgggtaccgcccgaaccccgtcccggaacggacgacccgaacgcccggcccggccccggttcgggccccgg

SEQ ID NO: 350205 - DNA, 540 bp, Homo sapiens
  misc_feature: GZ8MTXP02FFPCU.44.78.H01.1.454.CMB.2.raw
  modified_base (351)..(351): a, c, t, g, unknown or other
  misc_feature (351)..(351): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagtagtatgaccaggagcacctccccaggtacagtctacatggaactgagcagcctgagatctgaggacacggccgtgtatttcngtgcgagagccaccagcacctggcttgacttgtgggggcccagggaacccctggtcaccgtctcctcagccctccaccaagggccccagtcccggtccttcccccctgggccgcccctgcctcccgacggacgccaccctccgacggacgccacacgccggccctggggcctgcccgtggtcaaacggg

SEQ ID NO: 350206 - DNA, 571 bp, Homo sapiens
  misc_feature: GZ8MTXP02H9NB7.44.78.H01.1.454.CMB.2.raw
  modified_base (205)..(205): a, c, t, g, unknown or other
  misc_feature (205)..(205): n is a, c, g, or t
  modified_base (354)..(354): a, c, t, g, unknown or other
  misc_feature (354)..(354): n is a, c, g, or t
  modified_base (384)..(384): a, c, t, g, unknown or other
  misc_feature (384)..(384): n is a, c, g, or t
  modified_base (550)..(550): a, c, t, g, unknown or other
  misc_feature (550)..(550): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccnctggacaagggctggagtggatgggatggatgaagcctatagtggcaacacgggctttgcccagaagttccaaggcagagttagtatgaccgaggacgccaccctaccccgaggtacagtctacatggaactgagcagcctagagatcngagacacgggccttgttattcgtgtgcganacgcccacgagtccaccgtggccttagacgttcggtcgggggcccacggggaaccctgggtccaccggttctcctcacggcctacccgaccgaacgggcccacgtccgtcccttccccgtcggcccgtaccctggccctccggacgaccgccaccgtccgaagacncacgcggcccgccgtgggccg

SEQ ID NO: 350207 - DNA, 566 bp, Homo sapiens
  misc_feature: GZ8MTXP02GHVDU.44.78.H01.1.454.CMB.2.raw
  modified_base (521)..(521): a, c, t, g, unknown or other
  misc_feature (521)..(521): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacgggctttgcccagaagttccaaggcagagttagtatgaccaggagcaccctccccaggtacagtctacagtggaactgagcagcctgagatcgtgacggacacggtcgtgtatttctgtgcgagacgccacagccaccgtgcttgacgtttgggcggggacccaggggtaccctgggtaccaccggtcctcctacgacgccctaccgaccgaacgggcccctagtcccggtcccttcccccgtggcccgtccctggccctaccgaggacgccaccgtccgganacgcacgtacggccggcccgtgggactcgccgtacggactaacgg

SEQ ID NO: 350208 - DNA, 553 bp, Homo sapiens
  misc_feature: GZ8MTXP02JNU79.44.78.H01.1.454.CMB.2.raw
  modified_base (474)..(474): a, c, t, g, unknown or other
  misc_feature (474)..(474): n is a, c, g, or t
  modified_base (480)..(480): a, c, t, g, unknown or other
  misc_feature (480)..(480): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggctttgcccagaagttccaaggcagagttagtatgaccaggagcacctccccaggtacagtctacatggaactgagcagcctgagatctagacggacgacggccgtgtatttctgtgcgagacgccacgacgcacccgtgcttgacgttggtcggggaccagggtacccctgggtccaccgtctccctcacgcctccgaccgaacgggccccagtccggtcccttcccccgnggcccnccctcgcctcccgagcgccaccgtcgacgacgccacgacgtccggcccgtgggcctcgccgtaggctaaacgg

SEQ ID NO: 350209 - DNA, 541 bp, Homo sapiens
  misc_feature: GZ8MTXP02HT31M.44.78.H01.1.454.CMB.2.raw
  modified_base (358)..(358): a, c, t, g, unknown or other
  misc_feature (358)..(358): n is a, c, g, or t
  modified_base (379)..(379): a, c, t, g, unknown or other
  misc_feature (379)..(379): n is a, c, g, or t
  modified_base (503)..(503): a, c, t, g, unknown or other
  misc_feature (503)..(503): n is a, c, g, or t
  modified_base (524)..(524): a, c, t, g, unknown or other
  misc_feature (524)..(524): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacggctttgcccagaagttccaaggcagagtagtatgaccaggagcacctcccaggtacagtctacatggaactgagcagcctgagatctgagcacggccgtnttattctgtgcgagcgccacncgcaccgtggctttgacgtttggcggggccacgggaacctggtccaccggttcttccgcacgccctaccgaccgtaacggccctagtccgtcctccccgcggtccaccctgcctccgaggaccnccgacccgtccgaagcgcacnggtcccgcccgttggcc

SEQ ID NO: 350210 - DNA, 619 bp, Homo sapiens
  misc_feature: GZ8MTXP02H7BCD.44.78.H01.1.454.CMB.2.raw
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacgacgggtctttgcccagaagttccaaggcagagttagtatgaccaggacgcaccctccccgaggtaccagtctacataggactgagcagcctgagatcgtgacggacgaccggcgtagttactttcgtgtggcgagaccgccaccgcgctaccgtgtcttcgtacgttgggtcggggcccgtaacggggtaccccgttgggtaccaccggttcctccgtcgacgtccctacccgacgtaccgggcccacgtccgtccctcccccgtggaccctcccgtcgcccttacccgaacggtacccaccccgtacggaacgacgaccctaccgccggccggtcccggtcgggtcccgtcggcccgtacgggtacctaaacgggttaccc

SEQ ID NO: 350211 - DNA, 619 bp, Homo sapiens
  misc_feature: GZ8MTXP02I2JB9.44.78.H01.1.454.CMB.2.raw
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagagttccaaggcagagttagatgaccaggacgccacctccccaggtacagtctacatggaactgagcagcctganatcngaggacacggccgtgttacttcgtgtgcgagcgccacagccacgtggcttgaccgttgggtcggggaccgtaggggaccccttgggtaccctaccggtccttcccgtccaccgcccctacccgaacccgaacgggccccctaacggttccccggttccctccccccgtggcccccgtccccgtcgacccttccggaaccggccgaccccgtacccgtacccgggaacgtaccggcccaaaccggaccggccccggccccggtcggggtcccg

SEQ ID NO: 350212 - DNA, 538 bp, Homo sapiens
  misc_feature: GZ8MTXP02G1DPY.44.78.H01.1.454.CMB.2.raw
  modified_base (279)..(279): a, c, t, g, unknown or other
  misc_feature (279)..(279): n is a, c, g, or t
  modified_base (327)..(327): a, c, t, g, unknown or other
  misc_feature (327)..(327): n is a, c, g, or t
  modified_base (352)..(352): a, c, t, g, unknown or other
  misc_feature (352)..(352): n is a, c, g, or t
  modified_base (480)..(480): a, c, t, g, unknown or other
  misc_feature (480)..(480): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctgggaaaacttgagtgataaattgcttctggtatcagcagaggccaggccagccccctangctggtcatcttcagataatagcgcctgagggactcctgagcgcttcnccgtggcctacaactcgtaggaacnccggccactctcgaccatcagccgccgacccagccctctgactgaggctgactattactgtacagacgtagggaaaagtgactaagttggggtagtcgggacggagggaccaaggctcgaccgtttcncggtcacgccccaaggcctccgcccccgtcggtaccactcctccgtttccccaacccc

SEQ ID NO: 350213 - DNA, 598 bp, Homo sapiens
  misc_feature: GZ8MTXP02FZ6PA.44.78.H01.1.454.CMB.2.raw
  modified_base (490)..(490): a, c, t, g, unknown or other
  misc_feature (490)..(490): n is a, c, g, or t
  modified_base (521)..(521): a, c, t, g, unknown or other
  misc_feature (521)..(521): n is a, c, g, or t
  modified_base (562)..(562): a, c, t, g, unknown or other
  misc_feature (562)..(562): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaacgttccaaggcagagttagtatgaccaggagcacctccccaggtacagtctacatggactgagcagcctgagatcgtggacggacgaccggcgttgttactttctgtgcgagacgccacagccaccgtgcttgacgtttgggcggggcctaacggggacccttggtcccaccgtctccgtacgccgccctaccgaccgaacgggcccctaacgttccccggtccctttcccccggngggccccgtcccgtgccctccgaacgggtcncccgacccgtcgacgaccgccgaaccgcggcccggtcccgngggggtcccctacggtccgtcggaaccgtaaaccgg

SEQ ID NO: 350214 - DNA, 573 bp, Homo sapiens
  misc_feature: GZ8MTXP02GJT39.44.78.H01.1.454.CMB.2.raw
  modified_base (303)..(303): a, c, t, g, unknown or other
  misc_feature (303)..(303): n is a, c, g, or t
  modified_base (344)..(344): a, c, t, g, unknown or other
  misc_feature (344)..(344): n is a, c, g, or t
  modified_base (490)..(490): a, c, t, g, unknown or other
  misc_feature (490)..(490): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggctttgcccagaagttccaaggcagagttagatgaccaggacncaccctcccaggtacagtcacagtgaactgagcagcctganatctagaggacacggtccgtgtactttcgtagtgcgagacgaccaccgacgcacctggcttagacgttggcgggccaagggaccctggtccaccgtctccgtcacgccctaccgaccgaacggcccacgtccgtcccgttcccccnggtcccgtcccgtcgccctaccgacggaccgacccgacccgtaccgaacgacgaccgaacgcggtcccggcccgtacggcccg

SEQ ID NO: 350215 - DNA, 582 bp, Homo sapiens
  misc_feature: GZ8MTXP02HUM0Q.44.78.H01.1.454.CMB.2.raw
  modified_base (264)..(264): a, c, t, g, unknown or other
  misc_feature (264)..(264): n is a, c, g, or t
tcagacagtatatacacgaccggtgctcgatttagtgtgagtagtttgggtttgggggggtctcaggaggcagcactctcgggacgtctccaccatggcctgggctctactcctcctcagcctcctcactcagggcacagggtcctggggactgtctaccctgactcagccgcctcagtgtccgggactcctggtcagtcggtcaccatcttctgttcttccagcgacaattccactggccctttaaagctctatcatggtacncagtggtcccggccgacgccccaaagtcctctttacgacgttccttcgcggcttcggcagtccctggtcccgttttcggcctccagttctgaccacgccgcctccctcgaccatcaccaactccgctgacgatgacgctgacttactttgttgtgctattatttcgtattcctatacaaattatcgttacgttcggaagtcggggtacccgtcgtcagtcgtctgcgtcacgtaccaacggcccaaacccacgtcgtcacttccgtcttccccacccttcctaacttactaacttacgtcgtctacgtacggtccggg

SEQ ID NO: 350216 - DNA, 564 bp, Homo sapiens
  misc_feature: GZ8MTXP02GIHRN.44.78.H01.1.454.CMB.2.raw
  modified_base (351)..(351): a, c, t, g, unknown or other
  misc_feature (351)..(351): n is a, c, g, or t
  modified_base (485)..(485): a, c, t, g, unknown or other
  misc_feature (485)..(485): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacaatctcctgcacggcttctggatacacgttcatcaattatgatattaactgggtgcgacaggccgctggacaagggctggagtggatgggatggatgaagcctatagtggcaacacgggcttgcccagaagttccaaggcagagttagtatgaccaggagcacctccccaggtacagtctacatggaactgagcagcctgagatcgtgacggacacggcgtgtatttcngtgcgagacgccacagcaccgtgggcttgacgttgggtcgggggacccgagggggaaccccttggtccacccggttcctcctcgacgccctaccaaccgaacgggcccagttccggtcccttccccgtggcccnccctggcctccgaggacgccaccgtccgagacgccacgacggccggcccgtcggggctacggccgtaggtactaaacgg

SEQ ID NO: 350217 - DNA, 556 bp, Homo sapiens
  misc_feature: GZ8MTXP02I4X7Q.44.78.H01.1.454.CMB.2.raw
tcagacagtatatacacgaccggtgctcgatttagtgtgagtagtttgggtttgggggaagcagcatcggaggtgcctcagccatggcatggatccctctcttcctcggcgtccttgcttactgcacagggtccggggcctcctctgacctgactcagccatccctcactgtccgtgtccccaggacacacagtcactattacctgctcgtaggggaaacttgagtgaattaaatttgcttctggtatcagcagaggcaggccagccccctatgctggtcatcttcaggataataagcgccctcgagggactccctgacgcgcttctctggcctccaactcctacgggaacacggccactcctacgaccatcagccgccgacccacgcctcgtggatgaggctgactattacgtgtcagacggtagggaaacgtgacttaagttgggtgttcggcggagggacaagtctgaccgttgtcggtcgagacccgaaggtcctccggcccccttcgggtcctacgtcgtccgttccccaccctcctactactactttacg

SEQ ID NO: 350218 - DNA, 615 bp, Homo sapiens
  misc_feature: GZ8MTXP02IGQ82.44.78.H01.1.454.CMB.2.raw
  modified_base (293)..(293): a, c, t, g, unknown or other
  misc_feature (293)..(293): n is a, c, g, or t
  modified_base (338)..(338): a, c, t, g, unknown or other
  misc_feature (338)..(338): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatggatggatgaagcctatagtgcaacacggcttgccagagttcaaggcagagtagtatgaccaggancaccctcccaggtacagtctacagtgaactgacgcacgcctaganatcgtgagacgacggcgtagttactttcgtgtgacgagacgcccacgacgccaccgttggcctttaggacggtttgggtaccgggggaccgtaacgggggaaccccttggggtccctaacccggttccgtaccctcgaaccggcccctacccgaaccgaaccggggtccctaacggttcccggtccctttcccccggcggtccccgtcccttccgccctaccgacggtacgccctaccgccgaacgcgaccacgccggtcccgccgttcggggaccc

SEQ ID NO: 350219 - DNA, 738 bp, Homo sapiens
  misc_feature: GZ8MTXP02IZXUM.44.78.H01.1.454.CMB.2.raw
tcagacagtatatacacgaccggtgctcgatttagtgtgagtagtttgggtttgggggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctggggaaaacttgagtgaattaatttgcttctgtactcagcagacggccaggccacgcccctatcgctggtctattcctttcgaaggtaataaagtaagccggtccctcgaacggggtactccccgtagacgtccgtctttctcgtggcctaccaactccgtacgggaaccaccggcctactctacgacctactcacggccgccgaacccacgcccttcgtaggatcggaggtctacgtaacttacttacgtgtacgaacggtacggtaaggggtaaaacttggtacgtttaaagggtttcggggttggggtttacccggggaccggggtaaacggggtaacccgtaaacgggtccggttaccgggttaaacccggtttcgttcccggggttaaccgtacggtaacccccgggaaacgggtcccgttacccgggtcccccccgttaccgggttaccctacccggttcccgtttccccggttcccccggttcccccttcccggtttaccttaaaacttccgtttaaacccgg

SEQ ID NO: 350220 - DNA, 618 bp, Homo sapiens
  misc_feature: GZ8MTXP02G79YX.44.78.H01.1.454.CMB.2.raw
  modified_base (334)..(334): a, c, t, g, unknown or other
  misc_feature (334)..(334): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctcgtagggaaacttgagtgataatttgcttcgtggtatcagcagaggccaggccacgcccctatcgctggtcattctttcaggtataagtaacgccggccctgacgggtactcccgngacgcgtcttctccgtcgcctacctaacgtcgtacggaaccgcggccctactctacgaccatcgacgccgaccacccgacgcctcgtgactcggacgtctagacttagttacgtcgtacgacggtacggtagggtaaagtgtacgttaggttggggtcggtacgggacggtaacgggacgacggtcgtacggtaccgttccgtacggtaccgaccggacccgtaacggtcccgtccgtacccccggttcggtacctacccgttccgttcccgttccccgtcccc

SEQ ID NO: 350221 - DNA, 591 bp, Homo sapiens
  misc_feature: GZ8MTXP02G61D2.44.78.H01.1.454.CMB.2.raw
  modified_base (298)..(298): a, c, t, g, unknown or other
  misc_feature (298)..(298): n is a, c, g, or t
  modified_base (367)..(367): a, c, t, g, unknown or other
  misc_feature (367)..(367): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacggcttgcccagagttccaaggcagagtagtatgaccaggancacctcccaggtacagtctacagtggaactgagcagcctgagatctgaggacacggccgtgtatttcgngtgcgagcgccacagcacgtgcttgacgttggtggggccagggaccctggtacctaccgtcctcctcgacgccctcccgaaccgtacgggcccaacgttcccggtcccttccccccgtcgggtcccgcccccgttcgcccttcccggaacgggacccgacccgaaccccgttcccggaacggacgacccgaaccgacggtcccggtccccggtcggggtccccg

SEQ ID NO: 350222 - DNA, 569 bp, Homo sapiens
  misc_feature: GZ8MTXP02IELL9.44.78.H01.1.454.CMB.2.raw
  modified_base (361)..(361): a, c, t, g, unknown or other
  misc_feature (361)..(361): n is a, c, g, or t
  modified_base (425)..(425): a, c, t, g, unknown or other
  misc_feature (425)..(425): n is a, c, g, or t
  modified_base (469)..(469): a, c, t, g, unknown or other
  misc_feature (469)..(469): n is a, c, g, or t
  modified_base (498)..(498): a, c, t, g, unknown or other
  misc_feature (498)..(498): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggtctttgcccagaacgttccgaaggcagagttagatgaccaggagcacctccccaggtacagtctacatggaactgagcagcctgagatcgtggacggaccacggccgtgttatttcgngtgcgagacgccaccagcaccctgcttgacttggcggggccagggacccctggccaccgtctcncacgccctccgacgacgggcccacgtccggttaccttcccccgnggcccgtccctgacctcccgagggacccnccaccgtccgacgaccgcctaccgacggcccgggtcccgtcgggtcctcggtacccgtcgggtaccaacgg

SEQ ID NO: 350223 - DNA, 675 bp, Homo sapiens
  misc_feature: GZ8MTXP02G5FY3.44.78.H01.1.454.CMB.2.raw
  modified_base (355)..(355): a, c, t, g, unknown or other
  misc_feature (355)..(355): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgattattaacgtgggtgcgacaggccgctggacaagggctggagtggagtgggatggatgaagccctatagtggacaacgacggtcttgccagaagttccaaggcagagttagtatgaccgaggacgcaccctcccagtacagtactacagtaggaactgacgcacgctgagtntacgtacggacggtacgaccgggtccggttagttactttcgtagtcgacggacgacgacccaacgacgaccaccgtggtacgtttcggtaccggttggggtaccgggggacccgtaaacgggggtaacccccgttgggtcccgtaacccggttcccttcccgtaccaccggtacccctacccgaacccggaacccggggcccctacgttccccggttccccgttcccccgtgggcccctcccgtcgccctccggaaacggccgaccctaacccggccgaacgaccggaccaccggacggcccggcccggttagggccccg

SEQ ID NO: 350224 - DNA, 729 bp, Homo sapiens
  misc_feature: GZ8MTXP02ISY8B.44.78.H01.1.454.CMB.2.raw
  modified_base (360)..(360): a, c, t, g, unknown or other
  misc_feature (360)..(360): n is a, c, g, or t
  modified_base (380)..(380): a, c, t, g, unknown or other
  misc_feature (380)..(380): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggacaacgacggtcttgcccagaagtccaaggcagagttagatgaccgagacgccaccctcccgaggtacacgtctacataggaactgagcagctgagatcgtgacggacncgggtcgttgttactttcgnggtcgacgtagacgacccaacgacgcctaccgtggactttgacggtttggtaccgggggacccgaacgggggtaaccccgttgggtacccctaacccgggttccttacccgtccgtaaaccgttcccccgtacccgaaaccccggtaaaccgggggtcccccctaaacgggtttccccggttcccccgttttcccccccggcggggtcccccgtcccccgttacggttccccctaccccgggaaacgggtaccccgtaccccgaaacccccggttacccgggaaacggaccgacccggtaaaacccggaccgggggtcccccggtaccccgggtttacggggtccccgg

SEQ ID NO: 350225 - DNA, 587 bp, Homo sapiens
  misc_feature: GZ8MTXP02IPMBL.44.78.H01.1.454.CMB.2.raw
  modified_base (367)..(367): a, c, t, g, unknown or other
  misc_feature (367)..(367): n is a, c, g, or t
  modified_base (391)..(391): a, c, t, g, unknown or other
  misc_feature (391)..(391): n is a, c, g, or t
  modified_base (585)..(585): a, c, t, g, unknown or other
  misc_feature (585)..(585): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtcgtccccaggacacacagtcactattacctgctcgtagggaaacttgagtagattaaattgcttcgtggtatcagcgagacggccagccacgcccctatcgctgtcatcttcgagataatacgcgcctcgaggactcctgacgcgtcttctcctcggcctaccgaacgtcgtacgggaaccnccggcctaactcctacgacctacncgacgccgaccgcctacgcctagcgagtcgagtctagaccttaaattccgtgttacgaaggtacgggtagggaaacgtgtacgttaaggttggggtcggttcgggacggagggacaaggtccgtagtaccgttcgtacggcaacggccaacggtccgcccgtccctcggtccctctcccgtccgtttacccccncg

SEQ ID NO: 350226 - DNA, 558 bp, Homo sapiens
  misc_feature: GZ8MTXP02IMWYM.44.78.H01.1.454.CMB.2.raw
  modified_base (497)..(497): a, c, t, g, unknown or other
  misc_feature (497)..(497): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgacggacacggccgtgtatttctgtgcgagacgccaccagcacctggcttgacttggtcggggacccaggggaacccctggtccaccggtctcctcacgcctcccaaccgacgggcccacgtccggtcccttcccccgtggcccgtccctggcctcccgacgggacnccaccctcccggagaccgccacgacggccggccctggggcctcggcctcggtacaaacggg

SEQ ID NO: 350227 - DNA, 621 bp, Homo sapiens
  misc_feature: GZ8MTXP02FPXEI.44.78.H01.1.454.CMB.2.raw
  modified_base (369)..(369): a, c, t, g, unknown or other
  misc_feature (369)..(369): n is a, c, g, or t
tcagacagtatatacacgaccggtgctcgatttagtgtgagtagtttgggtttgggggcctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtagggaaacttgagtgataaattgcttctggtatcagcagaggccaggccacgccccctatcgctggtcatctttcaggataataagcggccctcgagggactcccgtgacgcgtcttctcctcggcctaccaactcgtacgggaacnccgggccactcacgaccatcacgccgccgacccagccctcgtcggatcgacggcttgaacttacttacgtcgtaccgaaggacggtagggaaaacgttgaacgttaaggttggggtacggttcgggacgggaacgggtaccgaaaggtccgttacggacccgtttcgtaccgggtacgtaccggaccccgaaggtcctcccggtccccccgttggtaccctccgtttccgtccggtttccccctaacccccg

SEQ ID NO: 350228 - DNA, 581 bp, Homo sapiens
  misc_feature: GZ8MTXP02HD1BB.44.78.H01.1.454.CMB.2.raw
  modified_base (308)..(308): a, c, t, g, unknown or other
  misc_feature (308)..(308): n is a, c, g, or t
  modified_base (375)..(375): a, c, t, g, unknown or other
  misc_feature (375)..(375): n is a, c, g, or t
  modified_base (510)..(510): a, c, t, g, unknown or other
  misc_feature (510)..(510): n is a, c, g, or t
  modified_base (518)..(518): a, c, t, g, unknown or other
  misc_feature (518)..(518): n is a, c, g, or t
  modified_base (525)..(525): a, c, t, g, unknown or other
  misc_feature (525)..(525): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgattattaacgtgggtgcgacaggccgcgtggaacaagggctggagtggagtgggatggatgaacgcctatagtgacaacgacggtcttcgccagaacgtaccgaaggcagagttagtatgacagganccaccctcccgagtacagtctacagtacgaactgagcacgcagagatcgtaggacgacgcggcgttnttactttcgtgtcgcgagacgcccacgagccacgtgtcttgacttgggcgggccacgggtacctgggtccaccggttcttccacgcgtacccaccgaaccgaaccgggtccctagttcccggtccccttccccgngggccccnccgttcncccgtcggaacggcacccaccgccgaagtacaccgacgcggtcccgccgttgggcc

SEQ ID NO: 350229 - DNA, 598 bp, Homo sapiens
  misc_feature: GZ8MTXP02IN4IT.44.78.H01.1.454.CMB.2.raw
  modified_base (368)..(368): a, c, t, g, unknown or other
  misc_feature (368)..(368): n is a, c, g, or t
  modified_base (569)..(569): a, c, t, g, unknown or other
  misc_feature (569)..(569): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtcgtccccaggacacacagtcactattacctgctcgtagggaaacttgagtgataattgcttctggtatcagcagaggccaggccacgccccctatcgctggtcattcttcgaggtataataacgcgccctgagggactcccgtgacgcgtcttctcctcgcctccaactcgtacggggaaccnccgggcctactcctacgacctactcacgccgaccgacccagccctgtcgatcggaggctagactattactgtcgaaggtacggtagggaaagtgtacgttaaggttgggtggttccgggagggaacgggaccaaggtcgtacggtacccgttcgtcggtaccacggacccgtaaggccgtaacccgccccgtccggtaccnccgttccggttcccgttcccccgtacccc

SEQ ID NO: 350230 - DNA, 533 bp, Homo sapiens
  misc_feature: GZ8MTXP02F9WSU.44.78.H01.1.454.CMB.2.raw
  modified_base (302)..(302): a, c, t, g, unknown or other
  misc_feature (302)..(302): n is a, c, g, or t
  modified_base (340)..(340): a, c, t, g, unknown or other
  misc_feature (340)..(340): n is a, c, g, or t
  modified_base (393)..(393): a, c, t, g, unknown or other
  misc_feature (393)..(393): n is a, c, g, or t
  modified_base (493)..(493): a, c, t, g, unknown or other
  misc_feature (493)..(493): n is a, c, g, or t
tcagacagtatatacacgaccggtgctcgatttagtgtgagtagtttgggttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggctttgcccagaagttccaaggcagagttagtatgaccaggancacctcccagtacagtctacatgaactgagcagctgantctgagacaggccgtgtattcgtgtgcgagacgcacagcactggctgcttggngggccaggacctggcaccgtcctctcacgcctaccaccgacggcccagtccgtccttcccccgtggccgccccgtgcctaccgacgggccaccgtacccnccggaagaccgcaaaccgcggccggcccgtcggggtcccg

SEQ ID NO: 350231 - DNA, 579 bp, Homo sapiens
  misc_feature: GZ8MTXP02HA95T.44.78.H01.1.454.CMB.2.raw
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactggggtgcgacaggccgctggacaagggctggagtggatgggatggatgaacgccctatagtggcaacgacggctttgcccagaagttccaaggcagagttagtatgaccgaggacgcaccctcccaggtacagtcacatggaactgagcagcctagagatcgtagaggaccacggccgtgttatttcgtgtcgcgagacgcccaacgacgacaccgtgcttgacgttggacggggccaacgggacccgtggacctacccggtctcctacacgccctaccgaaccgacggcccctagttcccggtacccttccccgcggcccgtccgtcgccctcgaacgggcacccgaccgtccggaacgcggaccacggcgccggcccgtcgggaccg

SEQ ID NO: 350232 - DNA, 580 bp, Homo sapiens
  misc_feature: GZ8MTXP02HZ14F.44.78.H01.1.454.CMB.2.raw
  modified_base (326)..(326): a, c, t, g, unknown or other
  misc_feature (326)..(326): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacgggctttgcccagaagttccaaaggcagagttagatgaccagagcacctccccaggtacagtctacatggaactgagcagcctgaganctgacggacacgccgtgtatttcgngngcgagacgaccacacgctacgtgcttagacgttcgggcgggacccgaaacggggtaacccctcggtacccacccgttctacccgtaccgacgtcccacccgaacccgaaccggacccgtaccgtccgtcccgttccccgtccggccgcccgtccgtccgtaccgacgacgaccgaccgtaccgacgacgacgacgacgccggccgcggcgcgccgtacgtacgtacg

SEQ ID NO: 350233 - DNA, 575 bp, Homo sapiens
  misc_feature: GZ8MTXP02FLO81.44.78.H01.1.454.CMB.2.raw
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtgcaacacgggctttgcccagaagttccaaggcagagttagtatgaccaggatccacctccccaggtacagtctacatggaactgagcagcctagagatcgtaggacggacacggcgtgttattctgtgcgagacgacccaccagccaccgtggtcttgaccgtttgggacggggcccgaacggggaccctcgggtcctaccgtctccctcacgccctcccgaccgaacgggccctacgtcccggttcccttcccccgtggccccgtccctgccctccgaacggccgtccaacccgtcccgagccgaccacgcggccggtccgcgggctcgccgtcgacgtaaccg

SEQ ID NO: 350234 - DNA, 583 bp, Homo sapiens
  misc_feature: GZ8MTXP02I4O0I.44.78.H01.1.454.CMB.2.raw
  modified_base (301)..(301): a, c, t, g, unknown or other
  misc_feature (301)..(301): n is a, c, g, or t
  modified_base (494)..(494): a, c, t, g, unknown or other
  misc_feature (494)..(494): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattacctgatattaactgggtgcgacaggccgctggacaagggctggagtggatgggatggatgaagccctatagtggcacacggcttgcccagagttccaaggcagagttagtatgaccaggacncacctcccagtacagtctacagtggaactgagcagcctgagatctgaggacgacggccgtgtatttcgtgtgcgagacgccaccgagccaccgtggcttgacgtttggcggggcccaaggggaccctgggtcccaccggttcctcctcacgcccctacgaccgaacgggccctagtcccggtccttcccccgnggtccccgtcccttcgccccgtaccgacgggaccgacccacccgtccggaaggaccggccaacgacggtcccggcccgtcggggtcccg

SEQ ID NO: 350235 - DNA, 708 bp, Homo sapiens
  misc_feature: GZ8MTXP02HYRQY.44.78.H01.1.454.CMB.2.raw
  modified_base (264)..(264): a, c, t, g, unknown or other
  misc_feature (264)..(264): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggattttccttgctgctaattttaaaaggtgtccagtgtgaggtgcagttggtggagtcgtgggggtaggtttggtaaagccgtggggactcctagctctcctgtgcncgcctcgtggattctacttcagtaacgccgtggatcgaccgtcgggtcccgccgaggcctaccgggaggggaaggggcgtggggaggttcggggttcggaccgttaagttaacggaaaccgaaaggtcgtagggacgggtacggggaacaggacaacgactaccggctcggaccgaacccggtaggaaaacggcaagacttacccaacctatacctacgaaaaggagaagttagtaaactttaaacgaaaagtacgttacggttagtacctcgtagacgaagtatacggaacgaacgaccgtaaggaaaccgaccggaaacggaaccaacgacgtccgtacttacgttacgtcgtacggtgggttactttcgggtttactaaccgggtttcccgggaacccggtaccggggtaaccccgttcggttaaccgtacccggttcccg

SEQ ID NO: 350236 - DNA, 700 bp, Homo sapiens
  misc_feature: GZ8MTXP02GVMF6.44.78.H01.1.454.CMB.2.raw
  modified_base (524)..(524): a, c, t, g, unknown or other
  misc_feature (524)..(524): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtgcaacacgggcttgccagaagttccaaggcagagttagatgaccaggagccacctccccaggtacagtctacagtaggactgagcagcctagagatcgtagacggacgacggtccgtagttacttcgtgtgcgagacgccaccagccaccgtgggtcttggacgttgggcggggacccgacggggtaaccccttgggtaccctacccggttcctacccgttaccgaccgtcccctacccgaacccggtaaccgggccccctaacgttccccgggttccccctttcccccccggngggtcccccgtcccccgttcggaccccgttcccggaacgggggaccctccccgaaccccggttacccggaacggtaacccggaccccgaaacccggccggggccccggggtacccccggttcggggggacccttaccggggccccgttttacgggggaacccgttaaaacccgggg

SEQ ID NO: 350237 - DNA, 604 bp, Homo sapiens
  misc_feature: GZ8MTXP02JHGY4.44.78.H01.1.454.CMB.2.raw
  modified_base (537)..(537): a, c, t, g, unknown or other
  misc_feature (537)..(537): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtgcaacgacgggctttgcccagaagttccaaggcagagttagtatgaccgaggagccacctccccaggtacagtctacatggaactgagcagcctaggagatcgtggacggtacgaccggtccgtgttatttcgtgtgcgagacgacccaccacgccaccgtggcctttaggaccgtttggggtcggggacccgtacgggaaccccgttggtacccgaacccggtcctccctacgaccgtccctaccccgaccgaaacgggtccccatcccgggttcccttcccccgtcgggccctcccgtacgccnccgacggggcaccgtaccgccgagcgaccacgcgccggccgtcggccgtcgccgtcggtacaaaccg

SEQ ID NO: 350238 - DNA, 581 bp, Homo sapiens
  misc_feature: GZ8MTXP02GM5SY.44.78.H01.1.454.CMB.2.raw
  modified_base (517)..(517): a, c, t, g, unknown or other
  misc_feature (517)..(517): n is a, c, g, or t
  modified_base (543)..(543): a, c, t, g, unknown or other
  misc_feature (543)..(543): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtgcaacgacggctttgcccagaagttccaaggcagagtagatgaccaggagcaccgtcccaggtacagtctacatggaactgagcagcctgagatctaggaggacacggccgttagtatttcgtgtgacgaagacgacccaccgaagccaaccgtggtccttagaccgtttgggcggggaccgacggggtaaccctcgggtaccaaccgttcctccgtacgaccgccctacccgaccgaacgggcccctagtcccggtcctttccccgnggcccgtccctgctcccgaggacccnccgaccgacgaacgacgaccacgcgccggtccgcggtc

SEQ ID NO: 350239 - DNA, 561 bp, Homo sapiens
  misc_feature: GZ8MTXP02HKT0W.44.78.H01.1.454.CMB.2.raw
  modified_base (298)..(298): a, c, t, g, unknown or other
  misc_feature (298)..(298): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacggcttgccagaagttccaaggcagagttagtatgaccaggncaccctcccaggtacagtctacatggaactgagcagcctgagatcgtgaggacacgggccgtgttatttcgtgtgcgagacgcccaccagcaccgtggtcttgacgttggtcggggccaggggaccctggccaccgtctcctcacgccctccacgacgggccctacgtcccggtcccttcccccgtggccccgtcccgtagcccgtccgacgggaccgtcccaacccgtccgaagcgcgaccgcggcccggcccgtgggcccg

SEQ ID NO: 350240 - DNA, 592 bp, Homo sapiens
  misc_feature: GZ8MTXP02ISCOQ.44.78.H01.1.454.CMB.2.raw
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (495)..(495): a, c, t, g, unknown or other
  misc_feature (495)..(495): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacggcttgcccagaagttccaaggcagagttagtatgaccaggagcacctccccaggtacagtctaacataggaactgagcagcctgagatctgaggacacggccgtgttatttcngtgcgagacnccacngccaccgtgcttgacttggcggggaccagggtaaccctggtccacccggtctccctcaccgccctaccgaccgaaccgggccctacgttcccggtacccttcccccgnggtccccgtccccgttagccccttaccggaacgggtaccgaccctacccgtcccggaagccgaccgaaccggacggccccggcccggtcggggtccc

SEQ ID NO: 350241 - DNA, 687 bp, Homo sapiens
  misc_feature: GZ8MTXP02HLAWN.44.78.H01.1.454.CMB.2.raw
  modified_base (298)..(298): a, c, t, g, unknown or other
  misc_feature (298)..(298): n is a, c, g, or t
  modified_base (353)..(353): a, c, t, g, unknown or other
  misc_feature (353)..(353): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtgcaacacgggctttgcccagaagttccaaggcagagttagtatgaccaggagcacctccccaggtacngtctacatggaactgagcagcctgagatcgtgacggacacggtcgtgtatttcgngtgcgagacgccaccgagccaccgtgggtccttacggacgtttggggcgggggacccgtaacgggggtaacccccgttggggtaccctaacccgggttccctcccgttaccgaaccggtcccccttacccccgaaaccggaaacccgggggtcccccttaacggttccccgggttccccttttcccccccgggcgggtcccccgtccccgttcgtacccgtacccggacggacccgtacccgtacccggtaccggaacggaccgtacccgaaccggccggcccgggtcccggtcggggtacccgtcggtacccggttacgggtaaccgtaacgg

SEQ ID NO: 350242 - DNA, 570 bp, Homo sapiens
  misc_feature: GZ8MTXP02IO7PE.44.78.H01.1.454.CMB.2.raw
  modified_base (513)..(513): a, c, t, g, unknown or other
  misc_feature (513)..(513): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtcgtccccaggacacacagtcactattacctgctcgtagggaaaacttgagtgataattgcttctgtatcagcagagccaggccacgccccctatcgctggtcatcttcaggataataacgcgacctcgacgggtactcccgtgacgtctcttctccgtcgctaccaactcgtacggaactcggcactctacgaccatcagccgcgacccgagcctcgtaggactcgagctgtactattactgtacagtacgtagggaagtgacgttaagttggggttgtacgggaggtaacgggactaacggcgtacggacccgtttcgtcggtaccncgaacccgaggtcctccggtccccctacggtactccgtccttccgttacccctaccc

SEQ ID NO: 350243 - DNA, 570 bp, Homo sapiens
  misc_feature: GZ8MTXP02JDQHJ.44.78.H01.1.454.CMB.2.raw
  modified_base (310)..(310): a, c, t, g, unknown or other
  misc_feature (310)..(310): n is a, c, g, or t
  modified_base (357)..(357): a, c, t, g, unknown or other
  misc_feature (357)..(357): n is a, c, g, or t
  modified_base (549)..(549): a, c, t, g, unknown or other
  misc_feature (549)..(549): n is a, c, g, or t
tcagacagtatatacacgaccggtgctcgatttagtgtgagtagtttgggtttgggggcctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctgggaaacttgagtgataattgcttctggtatcagcagagcaggccacgcccctatgctggtcatcttcaggtataataagcggccctnagggactccctgagcgcttctcctggcctacaactcgtacgggaacncggccactctacgaccatcacgccgccgacccagcctctggatgagctgactattaccgtgtacggacgtagggagtagtacgtacgttagggttggttacgggtcgggacgggacgtacgacggtacgtaccggtaccgtccggtacgtacggaccgtaccggacgtcccgtcccgtacccggtcgtaccncgttccgtccctccctacccc

SEQ ID NO: 350244 - DNA, 604 bp, Homo sapiens
  misc_feature: GZ8MTXP02F4G5L.44.78.H01.1.454.CMB.2.raw
  modified_base (317)..(317): a, c, t, g, unknown or other
  misc_feature (317)..(317): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctaggggaaaacttgagtgaataaatttgcttcctggtatcagcagaggccaggccacgccccctatgctggtcatcttcaggtataataagcgccctnagggactccctgatcgcttctccgtgcctcaagtctggcacgaccggcctccctcgacccgtctcgtgggcctccgaggcgtgacggatcggaggctagacttatttctgccttcctcaactatcgaccgagggtccgaacgttagggttttatcggttaccgtttacgggaaaacgttcggggaaaacccgtaaacgggttcccgtaaccgttacccgtaacgtaccgaaccgacccgaaacggacccccaaaccccctactacgttaccaacttcccgttacccg

SEQ ID NO: 350245 - DNA, 580 bp, Homo sapiens
  misc_feature: GZ8MTXP02GD7JQ.44.78.H01.1.454.CMB.2.raw
  modified_base (191)..(191): a, c, t, g, unknown or other
  misc_feature (191)..(191): n is a, c, g, or t
  modified_base (377)..(377): a, c, t, g, unknown or other
  misc_feature (377)..(377): n is a, c, g, or t
tcagacagtatatacacgaccggtgctcgatttagtgtgagtagtttgggtttgggggggtcacaagaggcagcgctctcgggacgtctccaccatggcctgggctctgctgctcctcactctcctcacccaggacacagggtcctgggcccagtctgccctgactcagcctgcctccgtgtctggggtcncctggacagtcggtcaccatctcctgcactggagccagcggtaatattcttagtcttaactttgtctcctggtatcaaacatcatccaggtaaacgcccccaaactcatcatctatgagcctaataagacgccctcgaggggttttctaaatcgtcttacacctcgcctcaacgtccggacaaacncggccctaccctagacaatctacgtgggcctcaggctagagacgagctgattatattgttgctcagtatgtttcgtcacctatcaacttattgtacctttagggaagttcgggaacctaaggtcaacccggttaccgtagggtaccacggaccccaaaacggaccccaaaaccccgacgttctaccaaccttcctttaccccg

SEQ ID NO: 350246 - DNA, 746 bp, Homo sapiens
  misc_feature: GZ8MTXP02GRDXA.44.78.H01.1.454.CMB.2.raw
  modified_base (280)..(280): a, c, t, g, unknown or other
  misc_feature (280)..(280): n is a, c, g, or t
  modified_base (369)..(369): a, c, t, g, unknown or other
  misc_feature (369)..(369): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctaggggaaaacttgagtagataaattgcttctgtatcagcagagccaggccacgcccctangctggtcatcttcaggataataagcggccctcgagggactcccgtgacgcgctttctccgtcggcctaccaactcgtacggggaaaccnccgggtaccaccgtcctacgaaccctatccgacgcccggaccgaaccccgaggccccttcgttagggattcgggaacggtccgttaggaacccttaattttaaacccgtcggtttaaccgaaacgggttaaacccggggttaagggggtaaaaaccgttgggttaaacccgtttaaaagggtttagggggttcgggtttaaccgggggaccggggtaaacgggggtaaccccgaaaagggtccgttacggggtaaacccggttttccgtacccggggttaccgaccgggtaccccgtaaacgggtccccgtccgggtccccccccgttaggggttaccccaccgtttcccgttcccggtttaccccccttacccccg

SEQ ID NO: 350247 - DNA, 562 bp, Homo sapiens
  misc_feature: GZ8MTXP02IVD11.44.78.H01.1.454.CMB.2.raw
  modified_base (353)..(353): a, c, t, g, unknown or other
  misc_feature (353)..(353): n is a, c, g, or t
  modified_base (497)..(497): a, c, t, g, unknown or other
  misc_feature (497)..(497): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaaagttccaaggcagagttagtatgaccaggagcacctccccaggtacagtctacatggaactgagcagcctgagatctgacggacacggcgtgtatttcngtgcgagacgccaccagcaccgtggcttgacttggtggggcccgaggggacccctggtccaccgtctcctcacgccctacccgacaaccggggccctacgtccggtccttcccccgtggcctccccgtgcctccgaacgggccncccgtaccgtaccgagaccgaccgacgacggccggcccgtcgggcctcgaccgttcggacgaacg

SEQ ID NO: 350248 - DNA, 578 bp, Homo sapiens
  misc_feature: GZ8MTXP02IWHGV.44.78.H01.1.454.CMB.2.raw
  modified_base (335)..(335): a, c, t, g, unknown or other
  misc_feature (335)..(335): n is a, c, g, or t
  modified_base (517)..(517): a, c, t, g, unknown or other
  misc_feature (517)..(517): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggacaacacgggtctttcgcccagaagttccaaggcagagttagtatgaccaggagcacctcccagtacagtcacatggaactgancagcctgagatctggacgacgacggccgtgtatttctgtgcgagacgcccacgagccaccgtggtcttagacgtttggcggggacccaggggtaacccttgggtaccctaccggtcttccgtcgacgtcccctaccgaaccaacggggccctaggttcccgtcccttacccccgtgggcccncccttgccctacgacgtacgccaccgtcccgaagacgccaacgcgaccggcccgtgggccc

SEQ ID NO: 350249 - DNA, 586 bp, Homo sapiens
  misc_feature: GZ8MTXP02F1QVD.44.78.H01.1.454.CMB.2.raw
  modified_base (303)..(303): a, c, t, g, unknown or other
  misc_feature (303)..(303): n is a, c, g, or t
  modified_base (344)..(344): a, c, t, g, unknown or other
  misc_feature (344)..(344): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacggcttgcccagaacgttccaaggcagagttagtatgaccaggacncacctcccaggtacagtctacatggaactgagcagcctgantctggagacacggccgtagtactttctgtcgcgtagacgaccaccgacgccacgtcggtcttacgaccgttggtcggggccgaacgggaacccgtcggtccaccggtcctccctcacgccctacccgaccgaacgggccccaacggtcccggtcctttcccccgcggtcccgcccgttcgcctccgacggacgcccgacccgtaccgaacgccgacaccggacgccggcccgtcggggcccg

SEQ ID NO: 350250 - DNA, 598 bp, Homo sapiens
  misc_feature: GZ8MTXP02H07DG.44.78.H01.1.454.CMB.2.raw
  modified_base (308)..(308): a, c, t, g, unknown or other
  misc_feature (308)..(308): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
  modified_base (438)..(438): a, c, t, g, unknown or other
  misc_feature (438)..(438): n is a, c, g, or t
  modified_base (450)..(450): a, c, t, g, unknown or other
  misc_feature (450)..(450): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggattttccttgctgctattttaaaaggtgtccagtgtgaggtgcaggttggtggagtcgtgggggaggtttggtaaagccgtggggatcccttagactctcctgtgcagcctctggattcacttcagtaacgcctggatgacctgggtccnccgaggctccgagggagggctggagtgggtgcgtatagaacaaagctagacggtgggacagcagactacgctgaccacggtgaaagcagatcacanctacaagagntagaatacaaaaagtatacgggtnactcttagacanagtagaaaccagaccctagaaaccaccggaaggacaacgacgtacccgtataaacttacctggttcctagggtacttgggtttacccaaggtttcccggggaaccgtacgggggtaaacccctcgggtaccctaacccggtttccccg

SEQ ID NO: 350251 - DNA, 658 bp, Homo sapiens
  misc_feature: GZ8MTXP02I8XQX.44.78.H01.1.454.CMB.2.raw
  modified_base (297)..(297): a, c, t, g, unknown or other
  misc_feature (297)..(297): n is a, c, g, or t
  modified_base (320)..(320): a, c, t, g, unknown or other
  misc_feature (320)..(320): n is a, c, g, or t
  modified_base (545)..(545): a, c, t, g, unknown or other
  misc_feature (545)..(545): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgattattaactgggtgcgacaggccgctggacaagggctggagtggatgggatggatgaacgcctataggtgacaacgacgggtctttcgacccagtaacgttccgaaggcaagtagttagtatgaccgaggacnccacctccccgaggtacagtcanataggaactgacgcagcctgagatcgtaggaccggaccgacggtccgttagttactttcgtgtcggacgacgacgacccaccgacgccaccgttcgggctttaggacgttcgggtacggggacccgtaacggggtacccctggtcccacccggttcctaccgtccgaccgtccctaacccgaccggtaacgggcccctacggttccccggtccctttcccccggnggtcccctccccgttgcccctacccggacgggtacccaccgtacccgtcgaacgacgacccgcgaccgggccccggtccgtcggccctacggtccgttacgggactaaaccgg

SEQ ID NO: 350252 - DNA, 709 bp, Homo sapiens
  misc_feature: GZ8MTXP02H0WHE.44.78.H01.1.454.CMB.2.raw
  modified_base (473)..(473): a, c, t, g, unknown or other
  misc_feature (473)..(473): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggattttcctgctgcttaattttaaaaggtgtccagtgtgaggtgcaggttggtggagtcgtgggggaggtttggtaaagccgtggggacgttcccttagactctcctgtgcagcctctggattcactttcagtaacgcctggatcgaccgtgggtcccgccgaggctaccggaggggaacggggctgggaggttggggttcggccgttaagttaacggaaacccaaaggtccgtagggacggggtcggggacaggcaagacctacggctggaccacccggtaggaaacgcaggacttaccacccatccagaaaganaagttagaaacttacgaaaaaggtacttaacgggtcgtaccttcgtacgacgtaagtaacgtacggaaaacctacggccctaaggaaaccgacccggaaggaaccaacgtacggtcccgttacttaaactttaccgtgggttacctttagggggtaactttcggggtttacgaaccgggtttccgggggaccgtaacgggggtaacccccttggggtcccctaacccggtttcccg

SEQ ID NO: 350253 - DNA, 674 bp, Homo sapiens
  misc_feature: GZ8MTXP02GUWCF.44.78.H01.1.454.CMB.2.raw
  modified_base (567)..(567): a, c, t, g, unknown or other
  misc_feature (567)..(567): n is a, c, g, or t
  modified_base (600)..(600): a, c, t, g, unknown or other
  misc_feature (600)..(600): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaacgcctatagtggcaacgacggcttcgccagaagttccaaggcagagttagtatgacaggacgcacctcccgagtacagtactacatagaactgacgcacgcctgagatcgtggaacggaccacggtccgtagttacgtttcgtgtcggacgaacggacgacccgaccgacgtcccacccgttgggtaccgtttaggtacgtttcgggggtacgggggaccccgtaaacgggggtaacccccgtttgggaccccttaacccgggtcctaccccgtaccgaccgtaccccgtacccgaacccgtaaaccggggcccctaacgttccccgggttcccccttcccccggnggacccccgtcccttcgccctccggacggaccnccgaaccccgtcggaaacgccgaccgaccggacgttcccggccggtcggcctcgcccgtacggtaccgaaacgg

SEQ ID NO: 350254 - DNA, 590 bp, Homo sapiens
  misc_feature: GZ8MTXP02HBDM8.44.78.H01.1.454.CMB.2.raw
  modified_base (340)..(340): a, c, t, g, unknown or other
  misc_feature (340)..(340): n is a, c, g, or t
  modified_base (366)..(366): a, c, t, g, unknown or other
  misc_feature (366)..(366): n is a, c, g, or t
  modified_base (557)..(557): a, c, t, g, unknown or other
  misc_feature (557)..(557): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaacgccctagtagtggcaacgacgggcttgccagagtccaaggcagagttagtatgacaggagccacctcccaggtacagtcacagtgaactgagcagctganatcgtgagcgacggcgtgttattcgngtgcgagcgacccacgagcctaccgtggtcttggccgttgggtacgggggccgtacgggtaacccgttgggtcccgtaccggttccctccgttccacgtacccctcccgaaccgtaacggcccctaacgtccggttcccttcccccgcggtcccgtccctcgccgtaccgacggaccgcctacccgtacgngacgccgaacggtcggccggcccgtgggtcccg

SEQ ID NO: 350255 - DNA, 661 bp, Homo sapiens
  misc_feature: GZ8MTXP02GCN3V.44.78.H01.1.454.CMB.2.raw
  modified_base (342)..(342): a, c, t, g, unknown or other
  misc_feature (342)..(342): n is a, c, g, or t
  modified_base (533)..(533): a, c, t, g, unknown or other
  misc_feature (533)..(533): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggacaacgacgggtcttgacccagaacgttccgaaggcagtagttagtagtgaccgaggacgccacccgtccccgaggtacagtctacagtggaactgagcacgcgtgagtntcgtaggacggacgtacggtccgttagttactttcgtggtcggacgaacgaaacccacgacgcctaccgtggtacttgtacgttgggacggggaccaacggggtaacccgtggtacctacccggttcctcccgtacaccggttcccaccgaaccggtacgggcccctaggttcccggtccctttcccccgnggccccgtccgtcgtcctacccggaggtacccgccgtacccgtccggaacggacgacccaacggcgggtccccggcccgttcgggggccctccgggtcccgtaacgggttacccaaacggtttaaccc

SEQ ID NO: 350256 - DNA, 661 bp, Homo sapiens
  misc_feature: GZ8MTXP02ISRBP.44.78.H01.1.454.CMB.2.raw
  modified_base (315)..(315): a, c, t, g, unknown or other
  misc_feature (315)..(315): n is a, c, g, or t
  modified_base (363)..(363): a, c, t, g, unknown or other
  misc_feature (363)..(363): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtcgtccccaggacacacagtcactattacctgctcgtaggggaaacttgagtgataattgcttctggtatcagcagaggccaggccacgccccctatcgctggtcattcttcaggataataagcgccctnagggactccctgagccgtcttctcgtcgctccaacgtcgtacggaacncgggccactctgacccatcgacgccgaccgacccgacgcccgtcgtggactcggaggtcctagacttacgtttactcggtacgacgggtacggttaggggaaaggttcgtaaccgtttaaggtttgggggttacgggttttaccgggggacggggtaaacggggtacccggtaaacggtaccggttacggaacccggtttccggtacggggtacccgacggtaccccggaaacggttccgtaacccggtcccccgttacgggtccctacggttccgttcccgttccccggttcccccg

SEQ ID NO: 350257 - DNA, 755 bp, Homo sapiens
  misc_feature: GZ8MTXP02HT97R.44.78.H01.1.454.CMB.2.raw
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggagtgggatggatgaagcctatagtggacaacgacgggtctttcgacccagtaacgttccaaggcagagttagtatcgacaggacgccacctccccgagtacagtctacatagactgacgcgacgccgtagagtatcgtggacgacgaccggcgtagtactttcgtgtcgcgagacgacccgaccgacgccaccgtgtacttacgtacgtttcggggcgggggtaacccgacgggggtaaacccccgttgggtacccctaccggtccttacccgtacgcccgtaccctaccccggaaccgtaaaccggggcccccttaacggttcccccggttccccgttcccccccggtgggtcccccgtacccccgtttcgaccccgttaaccccgacggggaaccccggtacccccgaacccccgttaccccgggggaaaacgtaacccggacccgtaaacccggacccgggggtccccggggtaccccccggttcgggggtacccccgttacccgggttaccccggttaacggggtttaaaccccgaaaccgggg

SEQ ID NO: 350258 - DNA, 803 bp, Homo sapiens
  misc_feature: GZ8MTXP02G9AM7.44.78.H01.1.454.CMB.2.raw
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggacgtcccttagactctcctgtgcagcctctggattctactttcagtaacgcctggatcgaccgtgggtcccgccgaggcctccggaggggaaggggcgtaggggaggttggggttcggacccggttaagttaacggaaacccgaaaaggtccgtaggggaacggggttacggggaaccacggaccaacggtaccttaccgggaccttcgggacccgtaaacccccgggtaggaaaacgggcctaaaggtactttacccgaaaccctagtacctacgaaaaggtagaaattaggtaaactttaacgaaaaaaggtacgttacgggttcgttaaccttccgttagaccgtaagaacgttacggaaaaccacggtacccctaaggaaaacccgaacccgggaacggaaacccaaccgtaacggtaccccggttacttaaacgtttaacccgtgggttaccgttagggggttaactttcggggtttaaccgtaacgggtttcccgggggacccggtaaacggggtacccccgtttacggggtaccctaaccccgggtttcccccg

SEQ ID NO: 350259 - DNA, 556 bp, Homo sapiens
  misc_feature: GZ8MTXP02H5HHW.44.78.H01.1.454.CMB.2.raw
  modified_base (422)..(422): a, c, t, g, unknown or other
  misc_feature (422)..(422): n is a, c, g, or t
  modified_base (445)..(445): a, c, t, g, unknown or other
  misc_feature (445)..(445): n is a, c, g, or t
tcagacagtatatacacgaccggtgctcgatttagtgtgagtagtttgggtttggggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcgacaattccactggccctttaaagtctctatcatggtacgcagtggtcccggccgacgcccccaaagtcctctttacgacgtcctttcgcggcttcggcagtccctggccgtttttcggccttccagttctgtaccacgcggcctccctgaccactcaccaaactccggcctgagatgagctgacttactttgttgngctatattcgattcactcaaatntgtcttggaagtcgggacccgcgtcagtccgtctgcgtcagcccaaggtcccaacccgatcgtcactctcgtcccctacctcctaactactactactgtcctgacgtcggg

SEQ ID NO: 350260 - DNA, 549 bp, Homo sapiens
  misc_feature: GZ8MTXP02FHLNF.44.78.H01.1.454.CMB.2.raw
  modified_base (299)..(299): a, c, t, g, unknown or other
  misc_feature (299)..(299): n is a, c, g, or t
  modified_base (358)..(358): a, c, t, g, unknown or other
  misc_feature (358)..(358): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagtagtatgaccaggagcacctccccaggtacngtctacatggaactgagcagcctgagatctgaggacacggccgtgtattctgtgcgagngccacagcacctggcttgacttggtcggggccaggggaaccctggtccaccgtctcctcacgccctcccaccgacgggccccagtcccggtccttccccccgtgggcccgcccctgccctcccgaggacgccacccgtccgacgacgccaccgacgccggcccgtcgggcctcgcccgtggtaccaaacgg

SEQ ID NO: 350261 - DNA, 638 bp, Homo sapiens
  misc_feature: GZ8MTXP02IXKT4.44.78.H01.1.454.CMB.2.raw
  modified_base (257)..(257): a, c, t, g, unknown or other
  misc_feature (257)..(257): n is a, c, g, or t
  modified_base (380)..(380): a, c, t, g, unknown or other
  misc_feature (380)..(380): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgattattaactgggtgcgacaggccgctggacaagggctggagtggatgggatggatgaagccctatagtgcaacncggtcttgccagagtccaaggcagagttagatgaccgaggacgcacctcccgaggtacagtacacagtcgaactgaagcacgcctgagatcgtagacggaccgacggccgttagttatttcgngtcgacggagacgcccacacgcaccgtggtacttgacgtttggggcgggaccgaacggggtaccccttggggtaccctacccgtcctccttaccgacgggccccctacccgaacccgtaacgggccctaacggttcccggttccctcccccgtcgggccccgtccctacggtccccttcggaaccggccgacccgaccccgttaccgggaacggacggacccaaccggacggcccccggggtccgttacgggggcccc

SEQ ID NO: 350262 - DNA, 655 bp, Homo sapiens
  misc_feature: GZ8MTXP02IHE67.44.78.H01.1.454.CMB.2.raw
  modified_base (344)..(344): a, c, t, g, unknown or other
  misc_feature (344)..(344): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacagggccgctggacaagggctggagtggatgggatggatgaagcctatagtggcaacacggcttgcccagaacgttccaaggcagagttagtatgaccaggagccacctccccaggtacagtcacatggaactgagcagcctgantctgagacacggccgtgttattcgtgtgcgagacgcccacacgccaccgtggcttcgtacgttgggtacgggggccgacggggaaccccgtgggtaccccaccggttccctcccgttcgaccgcccctaccccgaaaccgaacggggccccctaagttcccgggttacccccttcccccggtccgggtcccgtccccgtccggccttaccccggaacgggaccgtaccccgaacccgttaccccggggaacgtaaccggacccgtaacccggaaccggggcccccgggtaccccggttcggggtcccccgg

SEQ ID NO: 350263 - DNA, 609 bp, Homo sapiens
  misc_feature: GZ8MTXP02HKQ4I.44.78.H01.1.454.CMB.2.raw
  modified_base (458)..(458): a, c, t, g, unknown or other
  misc_feature (458)..(458): n is a, c, g, or t
  modified_base (513)..(513): a, c, t, g, unknown or other
  misc_feature (513)..(513): n is a, c, g, or t
  modified_base (532)..(532): a, c, t, g, unknown or other
  misc_feature (532)..(532): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaaatgggtgcgacaggccgctggacaagggctggagtggatgggatggatgaagccctatagtggcaacgacggcttgcccagaagttccaaggcagagttagtatgaccaggagccaccctccccaggtacagtctacatggaactgagcagcctgagatctagaggacacgggccgtgtattctgtgcgagcgcccacgagccacgtggtccttaggaccttgggcggggacccagggggtaacccctgggtcccacccggtcttacccnctacgacccctccgaaccgaacgggccccaacgttcccggtccctttccccccgngggtcccctccccggttanccccgtaccaggggaacccgtccctaacccggtcccgaaggccgtacccacgcggccccgggacccgttgggccccg

SEQ ID NO: 350264 - DNA, 655 bp, Homo sapiens
  misc_feature: GZ8MTXP02H328F.44.78.H01.1.454.CMB.2.raw
  modified_base (299)..(299): a, c, t, g, unknown or other
  misc_feature (299)..(299): n is a, c, g, or t
  modified_base (364)..(364): a, c, t, g, unknown or other
  misc_feature (364)..(364): n is a, c, g, or t
tcagacagtatatacacgaccggtgctcgatttagtgtgagtagtttgggtttgggggcctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtagggaaacttgagtgattaattgcttcctggtatcagcagagccaggccacgcccctatgctgcatcttcagataanagcgcctcagggactccctgacgcgtcttctcccgtcggcctaccgaactcgtacggggaaaccnccggggcctaaccgtcctacgaacccacgtaccgacggccgaccgaccccgaacgtcccgttcgtacggtacgttcgggaacggtcctaagggtaacccttagtttaccgtacgtacgtaaacggtaaccggggtagggtaaagtgtaaccgttaaaggtttggggtaggttacgggcggggaacgggaccgaacggtcgtacggtacccggtttcgtacgggtacaccggacccgtaacgccgtaaccggcccccgtcggtaccaccgttccttccggtcccccgtcccc

SEQ ID NO: 350265 - DNA, 630 bp, Homo sapiens
  misc_feature: GZ8MTXP02FJBHK.44.78.H01.1.454.CMB.2.raw
  modified_base (377)..(377): a, c, t, g, unknown or other
  misc_feature (377)..(377): n is a, c, g, or t
  modified_base (592)..(592): a, c, t, g, unknown or other
  misc_feature (592)..(592): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacaggggtccggggcctcctctgacctgactcagccatcctcactcgtccgtcgtccccaggacacacagtcactattacctgctcgtaggggaaacttgagtgataaattgcttcctggtatcagcaggacggccaggccacgccccctatgctggtcattcttcaggataataacggccgccctcgagggactcccgtgacgcgtcttctccgtcggtcctacaactcgtacgggaacnccggccactcgtacgacctatcacggccgaccgacccacgtcctcgtggactcggagtctacgtaactatttacgtacgtcgaaggtacgggtaaggggtaaaacgttgtaacgttaaggtttcgggggtacggttacgggggacggggtaacgggggaaccaaggtccgtacggtacccggttcttacggggactaccggacccgaaggtcccnccgtcccccgttagcctacgtcctaccgtcccctaccc

SEQ ID NO: 350266 - DNA, 661 bp, Homo sapiens
  misc_feature: GZ8MTXP02HIZZC.44.78.H01.1.454.CMB.2.raw
  modified_base (326)..(326): a, c, t, g, unknown or other
  misc_feature (326)..(326): n is a, c, g, or t
  modified_base (350)..(350): a, c, t, g, unknown or other
  misc_feature (350)..(350): n is a, c, g, or t
  modified_base (491)..(491): a, c, t, g, unknown or other
  misc_feature (491)..(491): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggattttccttgctgctattttaaaaggtgtccagtgtgaggtgcaggttggtggagtcggtggggggtaggtttagggtaaaggccgtgggggacgttcccgttaagaccttctcctgtcgcacgcctcgtggtattctacttcagtaacgctggatcgccgtgggccncgaggcctcgagggacggcgtggngtgggtgcgtatacgaacaagctaggacggtggacagcagtactacgctcgaccaccggtagaaacgcaagtacttccaacctatccgtacaaaggtagatagtaacttaacgaaaaagtagttaaccggtgttacccgtnttcggactaagacgtaacggaaactacgacccgtaaagaaacccgaaccggaggaacctaacacggtacccgtattaactttaccgtggtacgtagggttacgttggtttaccaacggtttcccgggaaccgtaaccgggggtacccttcgggttacccacccggtttcc

SEQ ID NO: 350267 - DNA, 560 bp, Homo sapiens
  misc_feature: GZ8MTXP02HOSNB.44.78.H01.1.454.CMB.2.raw
  modified_base (372)..(372): a, c, t, g, unknown or other
  misc_feature (372)..(372): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgacggacacgggccgttgtatttccttgtgcgagagccaccngcacctgcttgacttgtggggccaggggaccctggtccaccgtctcctcgagccctaccaccgaacgggccccatccgggtccttccccccgtggcccggcccctgtcctcccgaggtacgccaaccctcccggaagccgccacgacggccggccccgtcggggccgtcgcccgtcggttccgaaagg

SEQ ID NO: 350268 - DNA, 634 bp, Homo sapiens
  misc_feature: GZ8MTXP02IM77U.44.78.H01.1.454.CMB.2.raw
  modified_base (278)..(278): a, c, t, g, unknown or other
  misc_feature (278)..(278): n is a, c, g, or t
  modified_base (385)..(385): a, c, t, g, unknown or other
  misc_feature (385)..(385): n is a, c, g, or t
  modified_base (513)..(513): a, c, t, g, unknown or other
  misc_feature (513)..(513): n is a, c, g, or t
  modified_base (604)..(604): a, c, t, g, unknown or other
  misc_feature (604)..(604): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtcgtccccaggaccacacagtcactattacctgctcgtagggaaacttgagtgataattgcttctgtatcagcagcggcaggccacgcccctancgctggtcattctttcaaggtataaacgtaacggccggccctcggacgggtactccccgtgacgtccgtctttctcccgtcggcctccaacttcgtacggggaaccncgggtccacgtctcgacctagcacgccgcgacccagccctgtggatggacgtcgtacgaacttattacgtaggtcaacgggtacggtaggggtaaagtcgtacgttaaggttggggtcggttacgggnggtacgggacgtaacgtcgttacggtacccgttcggtacggactaccggacccgaaggggtccctaaccgggtccccccgttgggttaccncccgtttcgtcccggtttcccccttccccg

SEQ ID NO: 350269 - DNA, 661 bp, Homo sapiens
  misc_feature: GZ8MTXP02GOEZZ.44.78.H01.1.454.CMB.2.raw
  modified_base (460)..(460): a, c, t, g, unknown or other
  misc_feature (460)..(460): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtcgtccccaggacacacagtcactattacctgctcgtaggggaaaacttgagtagtataaatttgcttctggtatcagcagacggccaggccacgccccctatcgctggtctattcttcgaaggtaataaagtaacgccggtaccctcgaacgggtactcccgtagacgtccgtcctttactccgtcggcctaccaacgttccgtacgggaacacccgggccctactccgtacgtaaccatccgacgcccgtaccgaccccagtccctcgtaggancggagcgtacgacttagttacgtgtacgaggtacggagggtaacgtgtaacgttaggttcggggtcggttacgggacgggaacggggtaactacggacgttccggtaccggtttccgacggttaccgaccgtacccgtaacggtccgtcccggtcccccgtcggtacctacccgttcctcccggttacccccttacccccg

SEQ ID NO: 350270 - DNA, 538 bp, Homo sapiens
  misc_feature: GZ8MTXP02HG8KC.44.78.H01.1.454.CMB.2.raw
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacggctttgcccagaagttccaaaggcagagttagtatgaccaggancacctcccaggtacagtctacatggaactgagcagcctgagatcngaggacacggcgtgtattctgtgcgagagcacaacncacngngtgtcgtgtggcgacgaccgtcgtcacctctctcacgccaccaccgaacggaccgacgtccgtccgtccccgtccggccgcccgtcgccgtaccgacggacgaccgacccgtaccgaacgacgaccgacgaccgaccggcccgtcggcg

SEQ ID NO: 350271 - DNA, 575 bp, Homo sapiens
  misc_feature: GZ8MTXP02G7LZF.44.78.H01.1.454.CMB.2.raw
  modified_base (374)..(374): a, c, t, g, unknown or other
  misc_feature (374)..(374): n is a, c, g, or t
  modified_base (397)..(397): a, c, t, g, unknown or other
  misc_feature (397)..(397): n is a, c, g, or t
tcagacagtatatacacgaccggtgctcgatttagtgtgagtagtttgggtttgggggaagcagcatcggaggtgcctcagccatggcatggatccctctcttcctcggcgtccttgcttactgcacagggtccggggcctcctctgacctgactcagccatcctcactgtccgtgtccccaggaccacacagtcactattacctgctcgtaggggaaaacttgagtgaattaaatttgcttctggtatcagcagagcagccagcccctatgctggcatcttcaggataataagccggcctcgacgggactccctgagtcgcttctctcggctcctaactccgtacggggaacacggccacgtctcgacctacncagccgccgacccacgcctacgngactgagcgtgactattactgtacacgagtagggaaagtgagttaagttgggtcggttacggagggacgggaccaagtcgtagtacccgttcgtccggtacgacgacccgacggtcccgtccgtcccccgtcggtaccctacgtccgttccggtcccctccctcctctactaacttcg

SEQ ID NO: 350272 - DNA, 688 bp, Homo sapiens
  misc_feature: GZ8MTXP02F5114.44.78.H01.1.454.CMB.2.raw
  modified_base (313)..(313): a, c, t, g, unknown or other
  misc_feature (313)..(313): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcacttattacctgctcgtaggggtaaaacttgagtagaattaaagtttgcttcctggtatcagcagacggccacgccacgcccctatcgcgtgtcatcttcgaagataanaacgccggccctgacgggtactcccgtagacgcgtcttctccgcgtcctacaactcgtacggaactcggccacgtctacgacctatccacgaccgcctaacccgacgtcccgtacgtgggaatcgggacgtcgtacgtaacttacgttaacgttcggtaacgtaacgggtaccggggttaggggtaaaacggttggtaaaccggtttaaacgggtttgggggtagggtttaccggggacggggaaccggggtaaccgaaacggtccggtacggttaccggttcggtccggtaccgaccgttacccgaacggtacccgcccggtcccccgttaccggtacctaccgtttcccggtcccttacccccgttaaccccg

SEQ ID NO: 350273 - DNA, 598 bp, Homo sapiens
  misc_feature: GZ8MTXP02FLGAP.44.78.H01.1.454.CMB.2.raw
  modified_base (303)..(303): a, c, t, g, unknown or other
  misc_feature (303)..(303): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaacgtgggtgcgacaggccgctggacaagggctggagtggatgggatggatgaagccctatagtggcaacgacgggcttgcccagaagtccaaggcagagtagtatgaccaggacnccaccctcccaggtacagtctacagtggaactgagcacgcctgagatcgtaggacggacgacgggtcgtgttatttctggtgcggagcgcccacacgcctaccgtggtcttggacgttgggtacgggggcctaacggggaccctggtacccctaccgtcctcctacgacggtccctacccgaccggaacggccctacgtcccggttccctccccgcggcccgtccctcggcccgtaccgacggtaccgcctaccgcgaagaccgacaaccggccggtccggcccgtcgggtcccg

SEQ ID NO: 350274 - DNA, 733 bp, Homo sapiens
  misc_feature: GZ8MTXP02ISS5O.44.78.H01.1.454.CMB.2.raw
tcagacagtatatacacgaccggtgctcgatttagtgtgagtagtttgggtttgggggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctcgtaggggaaacttgagtgattaaatttgcttctggtatcagcagagccaggccacgcccctatgctggtctattctttcgaagaataagtaacgccggtaccctcgacgggactccccgtaggacgcccggtacctttcgtacgtcgggccctaacccgtaaaccttcccggtaacggggaaccaccgggtccctaccttaccgtacgaccctagccgacggacccgacccgggaaccccacggtcccctcgttcgggaaactcgggaacggcgttacgactttaacgttaccgttgtacgacggtacgggtaggggtaaaaggttcgtaacggtttaaggttcgggggttaggttacccgggggaggtaaccggggacctaaggtccgttacggtacccgtttacgtccggttaccgacccgtcccggtaacggccccgttacccggtcccccgttcggttaccctaccgtttcctccccggttacccccttacccgttaccctttacttacctacgtttaccg

SEQ ID NO: 350275 - DNA, 592 bp, Homo sapiens
  misc_feature: GZ8MTXP02HNRFX.44.78.H01.1.454.CMB.2.raw
  modified_base (381)..(381): a, c, t, g, unknown or other
  misc_feature (381)..(381): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagcctatagtgcacacggcttgccagacgttccaaggcagagttagtatgaccaggacgcacccgtccccaggacagtctacataggaactgacgcagcctgagatcgtgaggacgacggccgttgtattcgtgtgcgagacnccgaccagcacgtgcttgacgttgggacggggtccacgggggaaccccttgggtacccgtaccggttcccttacccgtcgacccgtccctacccgaaccggaaccggggtccccacggttccccgtcccgtttccccgcggcccgtcccgtcgccgtaccgacggaccgccaaccgtccgaacgacgccacggacgccggccgtcgggtcc

SEQ ID NO: 350276 - DNA, 596 bp, Homo sapiens
  misc_feature: GZ8MTXP02FWLYO.44.78.H01.1.454.CMB.2.raw
  modified_base (366)..(366): a, c, t, g, unknown or other
  misc_feature (366)..(366): n is a, c, g, or t
  modified_base (504)..(504): a, c, t, g, unknown or other
  misc_feature (504)..(504): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacgggcttgcccagaacgttccaaggcagagttagtatgaccaggacgcaccctccccgaggtacagtctacatggaactgagcagcctagagatcgtaggaccggacgacggtcgttgttacgtttcgngtgcgagacgcccaccagccaccgtgacttggacgttgggcggggacccgtaggggacccgttggacctacccggttctccctacgacgtccctaccgaacgaaaccgggtccctaagttccccggtaccttccccgnggccctcccgtcgcctaccgaggacctccaccggtccgacgacgaccgacacgggcccgtccgtcgggcctcggtaccgtcggtaccgaacg

SEQ ID NO: 350277 - DNA, 623 bp, Homo sapiens
  misc_feature: GZ8MTXP02GKWP8.44.78.H01.1.454.CMB.2.raw
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacggcttgcccagaagttccaaggcagagttagtatgaccaggacgcacctccccaggtacagtcctacataggactgacgcacgcctaggagatcgtgacggaccacggtccgtgttactttcgtgtcggacgagacgaccaccgagccacctggacctttagacgtttgggcggggacccgtacggggaaccccttgggccctaacccggtcctccctcgacccgtccctacccgaaccgaaccgggcccctagtccccggttcccttcccccggtcggcccgtcccctggtccctacccggagggaccctccacccgtccggaaggaccgcccgacgacggcccggtcccgtcgggcctcggtcctacggggtacctaaacggg

SEQ ID NO: 350278 - DNA, 567 bp, Homo sapiens
  misc_feature: GZ8MTXP02HT3JX.44.78.H01.1.454.CMB.2.raw
  modified_base (312)..(312): a, c, t, g, unknown or other
  misc_feature (312)..(312): n is a, c, g, or t
  modified_base (333)..(333): a, c, t, g, unknown or other
  misc_feature (333)..(333): n is a, c, g, or t
  modified_base (356)..(356): a, c, t, g, unknown or other
  misc_feature (356)..(356): n is a, c, g, or t
  modified_base (396)..(396): a, c, t, g, unknown or other
  misc_feature (396)..(396): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtagggaaacttgagtgataaattgcttctgtatcagcagaggccaggccacgccccctatcgctggtcatctttcaggataataagcgccctnagggatccctgacgcgcttcncctgcctccaactcgtgggaacnccggccaactctagaccatcagccgccgacccagcctcgngatggagctagattactatgtacaggtacgtagggaaagtgtacgtaagttggggtacgttcggacgggagggaccaagtcgtggtacccgttcgtcgggtaccacgacccgaacgggtcctaacccggtcccccgtacggtcctacctcccgttccgttaccccctcccc

SEQ ID NO: 350279 - DNA, 501 bp, Homo sapiens
  misc_feature: GZ8MTXP02I5PKL.44.78.H01.1.454.CMB.2.raw
  modified_base (287)..(287): a, c, t, g, unknown or other
  misc_feature (287)..(287): n is a, c, g, or t
  modified_base (366)..(366): a, c, t, g, unknown or other
  misc_feature (366)..(366): n is a, c, g, or t
  modified_base (432)..(432): a, c, t, g, unknown or other
  misc_feature (432)..(432): n is a, c, g, or t
  modified_base (471)..(471): a, c, t, g, unknown or other
  misc_feature (471)..(471): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgagcctatgtgcacaggcttgccagagttcaagcagagtagatgacaggancacctcccagtacagtcacatggactgagcagcctgagatctgaggacacggcgtgtattcgtgtgcgagcgccacgancactgcttgcttgcgggaccgaggaccgtggtccgaccgtcgtcctcacgcctccacgacgggccnctccggtcctccccgtcgccgccctgcctcgacgcgccncctcgaagcgacacgcgccgccgtcggacc

SEQ ID NO: 350280 - DNA, 615 bp, Homo sapiens
  misc_feature: GZ8MTXP02JKL12.44.78.H01.1.454.CMB.2.raw
  modified_base (254)..(254): a, c, t, g, unknown or other
  misc_feature (254)..(254): n is a, c, g, or t
  modified_base (390)..(390): a, c, t, g, unknown or other
  misc_feature (390)..(390): n is a, c, g, or t
tcagacagtatatacacgaccggtgctcgatttagtgtgagtagtttgggtttgggggaagcagcatcgggaggtgcctcagccatggcatggatccctctcttcctcggcgtccttgcttactgcacagggtccggggcctcctctgacctgactcagccatcctcactgtccgtgtccccaggacacacagtcactattacctgctcgtaggggaaacttgagtgaataaatttgcttctggtatcagcagnggcaggccagcccctatgctggtcatcttcaggtataagtaacgccggccctcgagggactccgtgacgcgtcttctcgtcgctacctactccgtagggaaccacggccactctcgccatcgacgccgccgaaccncgcctcgtgatggacggctagacgttattacgtgtacgaggtacggtaggggaaagttgtacgttaaggttcgggggtagggttccgggacggggtaacggggaccctaaggtccgtaggtacccggtttcgaccggttacgacgtaccgaacggtcctccggtcccccgtcggtccaccgttccgttcccgttaccctaccccttctacttactacgtttaccg

SEQ ID NO: 350281 - DNA, 634 bp, Homo sapiens
  misc_feature: GZ8MTXP02JOTDI.44.78.H01.1.454.CMB.2.raw
  modified_base (277)..(277): a, c, t, g, unknown or other
  misc_feature (277)..(277): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtagggaaaacttgagtagataaattgcttctggtatcagcagagcagccagcccctangctgtcatcttcaggataataacgcggtccctgagggactcccgtgacgtccgtcttcgtccgtcggcctaccaacttcgaggggaaccaccggccaacttccgacgaccactcaacgccgacctacccgagccctgtacgggatcggaggtctagaccttaataccgtgtacctaaggtacggtagggaaaagtgtacgttaaggttggggttacggttcgggacggggtaaagggacctaaaggtccgtacggtaacccggttcgttacggtacgaccggacccgtaacgtccgttccggacccccccgttgggtacccgtacctttccggtccccgtttaccccgtaacccccg

SEQ ID NO: 350282 - DNA, 631 bp, Homo sapiens
  misc_feature: GZ8MTXP02FU47H.44.78.H01.1.454.CMB.2.raw
  modified_base (374)..(374): a, c, t, g, unknown or other
  misc_feature (374)..(374): n is a, c, g, or t
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacgagggtccgggcctcctctgacctgactcagccatcctcactgtccgtgtccccaggaccacacagtcactattacctgctcgtagggaaaacttgagtgataaattgcttctgtatcagcagaggccaggccacgccccctatcgctggtcattcttcaggataagtaagccgacctcgagggactcccgtgacgcgtcttcgtccgtcgtcctaccaacgtcgtacgggaaccnccgggccactcctcgacctatcacgccgccgacccngcctcgnggatggacgctacgacttacgttactgacgaagtacgggtagggtaaaagtgtaacgttaaggtttggggtacggtttacggggacgggaacgggaaccgaacggtacgttacggtacccggtttcgaccggttacgacccgaccgtaaaccggccctaacccggtcccccgttacgtacccgttccttccgttcccggtaccccctttccccg

SEQ ID NO: 350283 - DNA, 646 bp, Homo sapiens
  misc_feature: GZ8MTXP02FN771.44.78.H01.1.454.CMB.2.raw
  modified_base (537)..(537): a, c, t, g, unknown or other
  misc_feature (537)..(537): n is a, c, g, or t
  modified_base (575)..(575): a, c, t, g, unknown or other
  misc_feature (575)..(575): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtgcaacgacgggcttgcccagaacgttccaaggcagagttagtatgaccaggagccaccctccccaggtacagtctacatggactgagcagcctgagatctggacggacacggcgtgttacttcgtgtgcgagacgcccaccgagcctaccgtggtctttaggaccgtttggggtccgggggacccgtaaagggggtaaccccccttggggtacccctaacccggttcctccccgttacgaacccggtcccctaccccgaaccggaaaccggggccccctagttcccccgggttcccttcccccggnggggcccctccccgtgccccgtacccgacgggtacccncccgaacccgtccggaacgaccgaccaccgcgggcccggccgtcgggcctccggccgtacggtaccaacgg

SEQ ID NO: 350284 - DNA, 678 bp, Homo sapiens
  misc_feature: GZ8MTXP02FO6V9.44.78.H01.1.454.CMB.2.raw
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaacgtgggtncgacgaggccgngtggacaagggctggagtggagtgggatggatagaacgcctagtagtggacaacgacggtcttcgacccaagaacgttaccgaaggcaagtagttaagtagtcgaaccgaggacgacctacccgtaccccgaaggtaccagttcctaacgagtaggaactagagcgacgcctagagactcgtaggacgaccgacgggtccgttagttaacttttcggtagtcggaacgacgaccgacccacgacggacctacggtgtcgttacgtcgttgggtccggggacccaacggtcccgtggtacccaccggttcctccgtcgaaccggtccctacccgaaccggaacggtcccctacggttcccggtcccccttcccggtcggaccccctcccgtacgtacccgtacccgacggtacccgacccgacccgtacccgaagacccgacgaccggccgtcccgggccgtcggtaccg

SEQ ID NO: 350285 - DNA, 695 bp, Homo sapiens
  misc_feature: GZ8MTXP02HRQNK.44.78.H01.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
tcagacagtatatacacgaccggtgctcgatttagtgtgagtagtttgggtttgggggaagcagcatcggaggtgcctcagccatggcatggatccctctcttcctcggcgtccttgcttactgcacgagggtccggggcctcctctgacctgactcagccatcctcactgtccgtcgtccccaggacacacagtcactattacctgctcgtagggtaaacttgagtgaattaatttgcttcngtatnagcagcgcaggccacgcccctagtcgcgtgtctacttctttacgaaggtaataaagtaacggcccggtccctacgaacggggtaccttccccgtaggtacgtccggttcctttccgttccgtacggtccctacccgtaaaccgttcccggtacggggaaacccaccgggaccctacttacccgacgacccacgtaccgacggacccgaccccgaacccgcgtccctcgtagcgttaaggcgttctagaactttacgttacgttcgacgagggtacggtagggtaaagtgtacggtttaaggttgggtcggtacgggaggtacggacgagtcgtcgtacgtcgtacgtcgaccgaccggtacgcccttccggccccgttcggtccctcgttcccgtttcccggtcccccgttaccccttcctttaccgttaactttacccgttaccgg

SEQ ID NO: 350286 - DNA, 538 bp, Homo sapiens
  misc_feature: GZ8MTXP02FF5TT.44.78.H01.1.454.CMB.2.raw
  modified_base (317)..(317): a, c, t, g, unknown or other
  misc_feature (317)..(317): n is a, c, g, or t
  modified_base (372)..(372): a, c, t, g, unknown or other
  misc_feature (372)..(372): n is a, c, g, or t
  modified_base (462)..(462): a, c, t, g, unknown or other
  misc_feature (462)..(462): n is a, c, g, or t
  modified_base (481)..(481): a, c, t, g, unknown or other
  misc_feature (481)..(481): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgancagcctgagatctgacggacacggcgtgtattctgtgcgagagccacagcactgnttgcttggtgggccaggggaccctgggtccaccgtctcctcacgcctcccaccgaaagggccccagtcccggtccttcccccgtggcccncccctgcctccgaacggcnccaccgtccgaacgacgccacacgccggcccgtcgggctcgccgtggtcccaaacgg

SEQ ID NO: 350287 - DNA, 681 bp, Homo sapiens
  misc_feature: GZ8MTXP02HB3K7.44.78.H01.1.454.CMB.2.raw
  modified_base (314)..(314): a, c, t, g, unknown or other
  misc_feature (314)..(314): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggaaagccgtggggatcccttagactctcctgtgcagcctcgtggacttctactttcaacgtaaccgcctggatcgacctgggtccnccgaggcctaccgagggacggctaggagtcggggttcgaccgttataacgaaaccgaaagcgtaggacggtcgggacagcaagacctacggctcgaccacccggtagaaaacggctaacgactttacccaaccctattccaacaaaggagtaagttaggtaaacttaaccgaaaaaggtacgttaaccgggtagttacctaccgtaggactaaggtatacggaaaactccgtaaccgtaacgaaacgacccggaaagacccgtaacgacggtacctacttacttacgtcgttccgtagggtacgtttcggtttacgtaacggttacccggaccggtaacggtaaccccgtggtaccctacccggtcc

SEQ ID NO: 350288 - DNA, 631 bp, Homo sapiens
  misc_feature: GZ8MTXP02IT1UI.44.78.H01.1.454.CMB.2.raw
  modified_base (228)..(228): a, c, t, g, unknown or other
  misc_feature (228)..(228): n is a, c, g, or t
  modified_base (280)..(280): a, c, t, g, unknown or other
  misc_feature (280)..(280): n is a, c, g, or t
  modified_base (327)..(327): a, c, t, g, unknown or other
  misc_feature (327)..(327): n is a, c, g, or t
  modified_base (515)..(515): a, c, t, g, unknown or other
  misc_feature (515)..(515): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgagcctatgngcaacgcggtcttgccagaacgttccaaggcagagttagtatgaccaggacnccaccctccccgaggtacagtctacagtaggactgagcagcctgagntcgtggacgacaccggtcgtgttactttcgtgtcgacgagacgacccaccgagcctaccgtgggtcttggtacgttggggacgggacccgtacggggtaccccgttggtaccctacccggttcctcccgtacaccgtccctacccgaaccgaaccgggccctacgttccccggttcccttcccccggngggtcccccgtcccgtcggccctcccggaacgggtccgacccgtaccgtccggaagtaccgacctaacgcggcccggcccggtcggccttcggcccggtttagaaccggtaaaccg

SEQ ID NO: 350289 - DNA, 616 bp, Homo sapiens
  misc_feature: GZ8MTXP02JE25F.44.78.H01.1.454.CMB.2.raw
  modified_base (249)..(249): a, c, t, g, unknown or other
  misc_feature (249)..(249): n is a, c, g, or t
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
tcagacagtatatacacgaccggtgctcgatttagtgtgagtagtttgggtttgggggaaggaggaagactgacggtcccactcccaggtacagctggtgcagtctggggctgaggtgaagaagcctggggcctcagtgacagtctcctgcacggcttctggatacacgttcatcaattatgatattaacgtgggtgcgacaggccgctggacaagggctggagtggatgggatggatgagcctatagngcaacgacggtcttgccagaattccaaggcagagttagatgaccaggacgctaacctccccaaggtacagtctaacatggaactgancagtcctgagntctagaggacgacggtccgtagttactttctgtgacgtaagcgacccacgacgccaccgtggcgttgacgttggcgggacacgggacccttgggtccacgtctaccgtcacgtccctacgaccgacgggtccctaacgtcccggttaccttcccccgtaggggtccccgtcccgttcggaccccgttaccggacgggtaccgttaccccgacccgttaccggaacggaccaccgaaccgccggaccccggtcccggtacggggtccccg

SEQ ID NO: 350290 - DNA, 674 bp, Homo sapiens
  misc_feature: GZ8MTXP02HEA6A.44.78.H01.1.454.CMB.2.raw
  modified_base (316)..(316): a, c, t, g, unknown or other
  misc_feature (316)..(316): n is a, c, g, or t
  modified_base (533)..(533): a, c, t, g, unknown or other
  misc_feature (533)..(533): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgattattaacgtgggtgcgacaggccgcgtggacaagggctgggagtggagtgggatggatgaacgccctagtagtggacaacgacggtcttcgacccagaacgttcaaggcaagtagttagtatgaccaggacnccacccgtcccgaggtacagtactaacagtaggaactgagcagccgtagacgtatcgtaggacggaccgaccgggtccgtttagtttaactttcgtacgttacggacggaagaccgacccaaccgacgaccctaccggtggttccgttaaggtccggtttggggaccgggggacccgtaaccggggacccttgggtaccctacccggtcctttaccnccgaccgtcccctaaccgaaccggaacggccctacgttccccgttcccttccccggcggtccccgcccgttacgccctaccggacgggaccacccgtaccgacgaacgacgtccgaacggccggcccggtccgtcgggccc

SEQ ID NO: 350291 - DNA, 601 bp, Homo sapiens
  misc_feature: GZ8MTXP02FQM45.44.78.H01.1.454.CMB.2.raw
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggtctttgcccagtaagttccaaggcaggagttagtatgaccaggacgccaccctccccgaggtaccagtctacagtcggaactgagcagcctagagatcgtgaggacacgggtccgtgttacttcgtgtgcgagacgacccacagcaccgtggcttgacgttggacggggtccgagggaacccctgggtacccaccgtcctccgttcacggccctacccgaaccgaacgggcccctagttcccggtccctcccccgtggcccgtccccgttgccctacccggacggtaccgcccgaccgtaccggaagacgaccgaaccgcggcccggcccgtgggtcccg

SEQ ID NO: 350292 - DNA, 658 bp, Homo sapiens
  misc_feature: GZ8MTXP02HEKEB.44.78.H01.1.454.CMB.2.raw
  modified_base (158)..(158): a, c, t, g, unknown or other
  misc_feature (158)..(158): n is a, c, g, or t
  modified_base (295)..(295): a, c, t, g, unknown or other
  misc_feature (295)..(295): n is a, c, g, or t
  modified_base (395)..(395): a, c, t, g, unknown or other
  misc_feature (395)..(395): n is a, c, g, or t
tcagacagtatatacacgaccggtgctcgatttagtgtgagtagtttgggtttggggacctgggcctcaggaagcagcatcggaggtgcctcagccatggcatggatccctctcttcctcggcgtccttgcttactgcacgagggtccgggcctcctntgacctgactcagccatcctcactgtccgtcgtccccaggaccacacagtcactattacctgctcgtagggaaaacttggagtgtaattaaattgcttcctggtactcgagcaggacgccaaggccacgccccctancgctgtctattcttgaacgataaacgtaagccgaccctagacgggtacttcccgagacgtccgtcttctccgtgcctaccgtactcgtacgggaaacccnccgtactactcgtacacctactacgacgccgaccgaccgtacgtccgtacgtagtagtacggacgtcgtacgtacttacgttacgtcgtacgtaacggtacgggtaagggtaacgtacgttaacgttagggttcgggttacgggtacggggacggtaacgggtacgtaacgtcgtacggttaccgtcgtaccggtacgaccggtaaccgacggtccgtcccggtcccggtcgtacctccgttccgttacccgttacccgtccc

SEQ ID NO: 350293 - DNA, 891 bp, Homo sapiens
  misc_feature: GZ8MTXP02JVLVA.44.78.H01.1.454.CMB.2.raw
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaacgtcctagtaggtggacaacgacgggtctttcggacccctaggtaacgttcccgaaagggcctaaggtagtttaagtaatcggaaccagggacgacccctaaccccgttcccccgaagggttacccaaggtttacccaaacgtacgtacggggaaaccttggaacggtaccgaacggtcccgttaaggaacgtaacgtccggtaggaacccgggacccgtaaccggggtcccgtttaggttaacgtttttccgtggttcggggacccgggtaaaggaccgtacccccgaaccgtaacggcccgtaaacccgttaggggtccctttaggtaacccgttttgggggacccgggggtacccgtaaaaaccggggggtacccccgttggggttaacccccgtaaacccgggtttcccttacccccgtaaacgccccgggttaacccccttaccccgtaaaacccgggaaaccgggggtcccccccttaaaggtttcccccgggttacccccgttttaccccccggtcggggaccccctttaccccccgggtcggtaaccccgtacccggtaacgggtacccacccgtaacccggtccggaaacggtccgaaccgaaccggccggttcccggtcccgttgggtaccctccggtaccggtaccggttacgtaaccg

SEQ ID NO: 350294 - DNA, 627 bp, Homo sapiens
  misc_feature: GZ8MTXP02G8SAW.44.78.H01.1.454.CMB.2.raw
  modified_base (312)..(312): a, c, t, g, unknown or other
  misc_feature (312)..(312): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggattttccttgctgctattttaaaaggtgtccagtgtgaggtgcaggttggtggagtcgtgggggtaggtttggtaaagccgtggggatcccttagactctcctgtgcagcctctggattcactttcagtaacgcctggatcgaccgtgggtccnccgaggcctccgaggggaggctggagtgggtggccgtatagaaccaaagctaggacggtggacagcaagactacgctcggccaacccggtagaaacggcaagacttaccaccctatcctacgaaagacatagaaacttaacaaaaggtactacgggtcgttactccttaggacctaagactaagaaaccacgtaccctaaggaaaccaacggaggaaccacgacggtcctacgttattaccgtggtccgtagggtacttcggtttcaacggtttccggggaccgacgggttaaccctcggtcccaacgttccccg

SEQ ID NO: 350295 - DNA, 565 bp, Homo sapiens
  misc_feature: GZ8MTXP02F3QEM.44.78.H01.1.454.CMB.2.raw
  modified_base (487)..(487): a, c, t, g, unknown or other
  misc_feature (487)..(487): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagttccaaggcagagttagatgaccaggagcacccgtccccaggtacagtctacatggaactgagcagcctgagatcgtgaggacacgggccgtgttatttcgtgtgcgagacgcccaccgagccacgtggcttggacttggtcggggccaggggaccctgggtccaccgtctcctcacgccctccaccgacggcccagtccggtcccttcccccgngggcccctcccgtcgacccgtccgacgggtccgaccacccgtcgaagccgacgaccgacggtccggccctggggcccg

SEQ ID NO: 350296 - DNA, 577 bp, Homo sapiens
  misc_feature: GZ8MTXP02FMXA6.44.78.H01.1.454.CMB.2.raw
  modified_base (303)..(303): a, c, t, g, unknown or other
  misc_feature (303)..(303): n is a, c, g, or t
  modified_base (377)..(377): a, c, t, g, unknown or other
  misc_feature (377)..(377): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaacgccctatagtggcaacgacggctttgcccagaagttccaaggcagagttagatgaccaggacncaccctcccgagtacagtctacataggaactgagcagcctgacgatctggaggacgacgggccgtgttatttcngtgcgagacgccacgagcacgtggcttgacgttggtcgggccgacggacccgttggtccaccgtctcctcacgcctacccgaccgacggcccctacgtccggtaccctcccccgcggcccgcccgtcgccctaccgaacggacctaccgacccgtaccgaacggacgaccaccggaccgtcccggacccgtcgggtcccg

SEQ ID NO: 350297 - DNA, 637 bp, Homo sapiens
  misc_feature: GZ8MTXP02I5748.44.78.H01.1.454.CMB.2.raw
  modified_base (314)..(314): a, c, t, g, unknown or other
  misc_feature (314)..(314): n is a, c, g, or t
  modified_base (427)..(427): a, c, t, g, unknown or other
  misc_feature (427)..(427): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggattttccttgctgctattttaaaggtgtccagtgtgaggtgcagttggtggagtcggtgggggtaggtttggtaaagccgtggggacgtccttagactctcctgtgcagcctctggtattcactttcagtaaccgcctggatcgaccgtgggaccnccaggcctaccggagggaggggctgggaggtcggggttcggaccgtagttaacgaaccaaagcgtaggacggtaggacagcagactacgctcgccaccggtagaacgcaagtntaccactatactacaaagactagtagaattaacgaaagtacgttacgtgtactcgtagactagactacgaaacgtacgaccgtaacgaaccgaacggacgaacacgacgtaccgtactacgtacgtacggtacgttggtacgttcggttacgtaacggttaccgggaaccggtaccgggtacccgtaccggtacccgtaccggttccccg

SEQ ID NO: 350298 - DNA, 616 bp, Homo sapiens
  misc_feature: GZ8MTXP02IB734.44.78.H01.1.454.CMB.2.raw
  modified_base (328)..(328): a, c, t, g, unknown or other
  misc_feature (328)..(328): n is a, c, g, or t
  modified_base (357)..(357): a, c, t, g, unknown or other
  misc_feature (357)..(357): n is a, c, g, or t
  modified_base (360)..(360): a, c, t, g, unknown or other
  misc_feature (360)..(360): n is a, c, g, or t
  modified_base (394)..(394): a, c, t, g, unknown or other
  misc_feature (394)..(394): n is a, c, g, or t
  modified_base (408)..(408): a, c, t, g, unknown or other
  misc_feature (408)..(408): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaatttatgatatttaacgtggggtgcgacaggccgctggacaagggctggagtggagtgggatggatgaacgcctatagtggacaacgacgggctttgcccagaacgttccaaggcagagttagtatgaccaggacgcacctcccaggtaacngtactacatggaactgaagcagcctgagntcngaggacacggcgttgttatttcgtgtgcgagacncccacagcacgtgnttcgtacgttggcgggccacgggaaccctggtacccaccggtcttccgctaaccgccctacccgaaccgaacgggtcccctacggttcccgtcccgtttcccccggcggcccgtaccccttcggacccttcccggaaacggcccgaccgtaccccgaccggaacggaccgtaccgaaaccgacgggtccccggcccggttcgggcccg

SEQ ID NO: 350299 - DNA, 683 bp, Homo sapiens
  misc_feature: GZ8MTXP02GHCFF.44.78.H01.1.454.CMB.2.raw
  modified_base (384)..(384): a, c, t, g, unknown or other
  misc_feature (384)..(384): n is a, c, g, or t
  modified_base (401)..(401): a, c, t, g, unknown or other
  misc_feature (401)..(401): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacgagggtccggggcctcctctgacctgactcagccatcctcactgtccgtcgtccccaggaccacacagtcacttacttacctgctacgtaggggtaaacttgagtagtaattaattgcttctggtatcagcagacggccacggccacgcccctatcgcgtgtctattcttacgaggtataagtacggccgtacctggagggtctcccgtgacgcgtcttctccgtcgacctccaactcgacggacnccgcactctacgacctnccgacgccgacccgtacccacgtcgttcgtacggacgtcggtaacggtccttaacgtacgttactttaccggtacgtaacggacggggttaacgggtaaggggtaaagttacggtacggtttaggggtttagggggttccgggttaacgggggaccggggttaacgggaaaccccggtaggtccgttacggttaccggtttcggtaccggaccgtacggacccgacggttccctcccggtcccccgttacggtcctccgtaccgttcccgttaccccttacc

SEQ ID NO: 350300 - DNA, 655 bp, Homo sapiens
  misc_feature: GZ8MTXP02HI8C8.44.78.H01.1.454.CMB.2.raw
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtgcaacacggcttgcccagaagttccaaggcagagttagtatgaccaggagccacctccccaggtacagtctacatggaactgagcagcctgagatctaggaggacacgggccgtagttatttcgtgtgcgagacgcccacagccaccgtggccttgacgttggtcgggggaccacggggtaaccctgggtaccctacccggttcctccgtacgaccgtcccctacccgaaccgaaaccgggcccctaacgttcccggttaccccttccccccggtcgggcccccgtcccccgttcggccccttacccggaaacgggacccgacccctaacccccggttacccggaaacggaccgacccgaaacccggacgggtcccccgggtccccgggtttacggggtcccccgg

SEQ ID NO: 350301 - DNA, 769 bp, Homo sapiens
  misc_feature: GZ8MTXP02HDNGV.44.78.H01.1.454.CMB.2.raw
  modified_base (389)..(389): a, c, t, g, unknown or other
  misc_feature (389)..(389): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacgagggtccgggcctcctctgacctgactcagccatcctcactgtccgtcgtccccaggaccacacagtcactattacctgctacgtaggggtaaaacttggagtagaattaaattgctttcctggtatcagcagacggcaggccacgcccctatgctgctattcttacaggtataagtacgccgacctgacgggactcccgtgacgtctctttacgtccgtcgtcctaccgtaactcggtacgggaaaccnccgggaccctacgtccgtacgaccctagtccgaaccggccgacccgaccccgtcgtccctacggtgaacgttacggcggttacccttaagggttacttaacggtttaactcgggttaaacgacggggttaaacgggtacggggtaaaaaggtttcggtaaccgtttttaaaggggtttacggggggtttcggttaccgggggtaccgggaaacggggtaaccgttaaacggtcccggttaacgggtttccccggttaacgggtttccggaacgggttaccccgaccggtaaaccgggttcccgccccggtttcccccccggttaggttacccccttaacccggtttccccgttcccggtttaaaccccccttttaccccg

SEQ ID NO: 350302 - DNA, 723 bp, Homo sapiens
  misc_feature: GZ8MTXP02FUB8S.44.78.H01.1.454.CMB.2.raw
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacgagggtccgggcctcctctgacctgactcagccatcctcactgtccgtcgtccccaggacacacagtcactattacctgctcgtaggggaaacttgagtgaataattgcttctggtatcagcagagccagccacgcccctatgctgtctatcttcgaaggtataagtacgcgaccctgacgggactccgtgacgcgtcttctccgtcggtccctaccgaaacgttccggtaacggggaaccgcccgggtccctaactccgtaccgaacccttaagtacccgaacggcccgacccgtaaacccccgacgtcccctacggttaggacgttacggacgggttacttacggtaaccttaagttaccgtaggttaccggaacgggttacgggttaaggggtaaacgttgtaaccggtttaagggtttcgggggttagggtttcgggaacggggaacgggtacccgaaaggtccgttaaaccggttccgtttaccggtaccggttaccgaaccggacccgaacgggttccccgtcccggtacccccgttcggtaccctacccgtttccggttacccctttccccgttaccc

SEQ ID NO: 350303 - DNA, 697 bp, Homo sapiens
  misc_feature: GZ8MTXP02JHPUM.44.78.H01.1.454.CMB.2.raw
  modified_base (335)..(335): a, c, t, g, unknown or other
  misc_feature (335)..(335): n is a, c, g, or t
  modified_base (376)..(376): a, c, t, g, unknown or other
  misc_feature (376)..(376): n is a, c, g, or t
  modified_base (396)..(396): a, c, t, g, unknown or other
  misc_feature (396)..(396): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacgaggggtccggggcctcctctgacctgactcagccatcctcactcgtccgtcgtccccaggacacacagtcacttattacctgctcgtagggaaacttgagtgtaataaattgcttcgtggtatcagcagacggcaggccacgcccctatcgctggtcattcttacagtataacaagcggcctagacgggctcccgngacgcgtcttctccgtcggcctacctacgtcgtaggaaccncggcctactctacgaacctntccgacgcccgaccgacccacgcccgtagtcggactcgggacggtcctagactttaattacgtcgacgtaacggtacgggtaaacggggaaagttcgggtaacgtttaaggggtttcgggggttacggggttaccggggaacgggggtaacgggtaaaccgtaaacgggttccgttaacgggttaacccggtttccggtaccgggttaccgaaccgggtacccggtaacgggtcccgttaaccgaccccccggttcgggttaccctaccggtttaccgtcccggtttacccccgttccccg

SEQ ID NO: 350304 - DNA, 569 bp, Homo sapiens
  misc_feature: GZ8MTXP02HQVJT.44.78.H01.1.454.CMB.2.raw
  modified_base (407)..(407): a, c, t, g, unknown or other
  misc_feature (407)..(407): n is a, c, g, or t
  modified_base (473)..(473): a, c, t, g, unknown or other
  misc_feature (473)..(473): n is a, c, g, or t
  modified_base (542)..(542): a, c, t, g, unknown or other
  misc_feature (542)..(542): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgattattaacgtgggtgcgacaggccgctggacaagggctggagtggatgggatggatgaagccctatagtgacaacacgggcttgccagaagttccaaaggcagagttagtatgaccaggacgccaccctccccgaggtacagtctacagtaggaactgacgcagcctggagactcgtaggacggaccgacgggtccgttagttactttcgtgtcgacgagaccnccacagctaccgtggtacttgacgtttggcggggaccacggggtaccctggtcccaccgttctccncacgtcccacgaccgacggccctagtcccgttcctcccgcggccctccgtgacctcgaacgcaccgccncgaagcgtcacgcgccgcgtcggaccg

SEQ ID NO: 350305 - DNA, 581 bp, Homo sapiens
  misc_feature: GZ8MTXP02I3VT5.44.78.H01.1.454.CMB.2.raw
  modified_base (298)..(298): a, c, t, g, unknown or other
  misc_feature (298)..(298): n is a, c, g, or t
  modified_base (515)..(515): a, c, t, g, unknown or other
  misc_feature (515)..(515): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtgcaacgcgggtcttgcccagaagttccaaggcagagttagtatgacaggacgcacctccccaggtacngtactacagtggaactgagcagcctgagtatcgtggacggacacggtcgtagttatttcgtgtgcgagacgcccacgagctaccgtggctttgacgtttgggcgggggccaacggggtacccttggtaccaccgtctcctcgacgtccctacccgacgaccgggccctacgtcccggtccctccccgtggccctcccgtgaccctccgacgggtacncccgacccgtcggacaccggccaaccgcggcccggccgtcgggctacgccgtaggtaccgaaacgg

SEQ ID NO: 350306 - DNA, 714 bp, Homo sapiens
  misc_feature: GZ8MTXP02FWX8A.44.78.H01.1.454.CMB.2.raw
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactcgtccgtcgtccccaggacacacagtcactattacctgctcgtagggaaacttgagtgattaaattcgcttcgtggtatcagcagaggccaggccacgccccctatcgcgtggtcattccttcgagataataacggccggtccctcgacggggactcccgtggacgtcctcgtttctcccgttcggccctaccgtaaccgttcgtaacggggtaaacccgccggggtaccccaaccgttacgtaccggtaaccctacgtaccgacgggacccgacccggacccccgaacgtccccgttcgtacgggaaacgtcggaacgggttccgtacggtaaaccttacgtttaaaccgtggttaaccgaacgggtacgggttaaggggtaaacgttcggtaacgttaaggtttcgggggttacggttcggggacggggaacgggtaccaagggtctacgggtaccgttccggtcggtacgacgtaacccgaggtcccgccggtccccgtcgttaccgcctttccggtacctccccttacccc

SEQ ID NO: 350307 - DNA, 568 bp, Homo sapiens
  misc_feature: GZ8MTXP02FF9WC.44.78.H01.1.454.CMB.2.raw
  modified_base (353)..(353): a, c, t, g, unknown or other
  misc_feature (353)..(353): n is a, c, g, or t
  modified_base (357)..(357): a, c, t, g, unknown or other
  misc_feature (357)..(357): n is a, c, g, or t
  modified_base (486)..(486): a, c, t, g, unknown or other
  misc_feature (486)..(486): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaaggctggagtggatgggatggatgaacgccctatagtgcaacacgggctttgcccagaacgttccaaggcagtagttagtatgaccgaggacgccaccctcccaggtacagtctacatggaactgagcagcctgagatcgtgagacacggctgtattcnggtncgagcgccacagcacctgtcttgacgttggtcggggaccgacgggaacccctggtcccaccgtcctcctcgacgccctacccgaaccgaaccgggccctacgtcccggtcccttcccccgtgggtcccncccgttcgcccgttcccgaggtacgccctacccgcgacgacgccaacgcgtccggccctgggcctcgcgtacgtacgaacgg

SEQ ID NO: 350308 - DNA, 733 bp, Homo sapiens
  misc_feature: GZ8MTXP02HDJC2.44.78.H01.1.454.CMB.2.raw
  modified_base (252)..(252): a, c, t, g, unknown or other
  misc_feature (252)..(252): n is a, c, g, or t
  modified_base (336)..(336): a, c, t, g, unknown or other
  misc_feature (336)..(336): n is a, c, g, or t
  modified_base (428)..(428): a, c, t, g, unknown or other
  misc_feature (428)..(428): n is a, c, g, or t
  modified_base (633)..(633): a, c, t, g, unknown or other
  misc_feature (633)..(633): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgattattaacgtggggtgcgacgacggccgcgtgggaacaagggctgggagtggagtgggatggatagaacncctagtaggtggacaacgacggtcttcgacccaagtaacgttaccgaaagggctaaggtagtttagtagtacgaaccgaggacnccaccccgtacccgaggtacacgtactacagtacggaactgagaccacgccgtagagattcgaggacggacgcgggtcgttgttactttcgngtcgacgacgccgacccactacgcctaccggtgtcgttaggtaccggttggggaccgggacccgtaaacggggtaccccgttggtaccccgtaccggttcccctttaccgaccgacccggttcccccgaacccgaacccggaacccgggtcccttacgttccccgggttacccccgttccccggtacccggcccggttcccccgngttaccccggaccgtaaccggggtaccgtacccccaccggtaccggaacggtaccgacccgtaaccggccggcccccgggtcccgttcgggggtcccccg

SEQ ID NO: 350309 - DNA, 715 bp, Homo sapiens
  misc_feature: GZ8MTXP02HB64R.44.78.H01.1.454.CMB.2.raw
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtcgtcccaggacacacagtcactacttacctgctcgtagggtaaacttgagtgtaataattgtcttctggtatcagcgagagccgaggccacgcccctatcgcgtcggctattcttacgaacggtaataaagtaacggcccggtcctacggacgggtacctcccgtaggacgtccggtcttcgtcccaccggtcctaccgaccgttcgaccgggaacctacccgggcctactaccgtcaacctacgtccgaacgcccgacccgacccgtaccgcccttacggtacgtagtacgggtacggtaccgtacggttaaaccttacgttaccggtacgttaacgaacggggttaacgggtaagggttaaaagggtcgttaaccgttaagggttttcgggggcgggtttaaccggggacggggtaacggaaccgtaacggtccgttaacggggtccgttcgtaccggtaccgaccgtaccggtaacggcctccccggtacccgtcggttacctacctccgtccgttacccctccccg

SEQ ID NO: 350310 - DNA, 669 bp, Homo sapiens
  misc_feature: GZ8MTXP02IE12M.44.78.H01.1.454.CMB.2.raw
  modified_base (334)..(334): a, c, t, g, unknown or other
  misc_feature (334)..(334): n is a, c, g, or t
tcagacagtatatacacgaccggtgctcgatttagtgtgagtagtttgggtttgggggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctaggggaaaacttgagtgaattaaatttgcttctggtatcagcagaggccaggccacgcccctatgctggcattcttcgaaggtataagtaacgcggccctgagggtactccgtgacgcgtctttcncgtaggccttaccgaacttccgtacggggaacctaccgggcctaacgtctacggacccataccgaggcccgaccgacccagccctcgtgactgacggctagaccgttattaccgtgtacacggtacggtagggaaacgttgaacgtttaaggtggggtttacggttcggggaaccggtaggggaacccgtaagtaccggttcggtaacccggtttgtacccggggttcgaaaacggccccgtaaacggtcccgtacccggcccccgttcgggtcctaaccggtccttcccggttaccccctaaccccgttctaacccgtttataaccctttccgg

SEQ ID NO: 350311 - DNA, 565 bp, Homo sapiens
  misc_feature: GZ8MTXP02FHL2S.44.78.H01.1.454.CMB.2.raw
  modified_base (257)..(257): a, c, t, g, unknown or other
  misc_feature (257)..(257): n is a, c, g, or t
  modified_base (321)..(321): a, c, t, g, unknown or other
  misc_feature (321)..(321): n is a, c, g, or t
  modified_base (497)..(497): a, c, t, g, unknown or other
  misc_feature (497)..(497): n is a, c, g, or t
  modified_base (504)..(504): a, c, t, g, unknown or other
  misc_feature (504)..(504): n is a, c, g, or t
  modified_base (557)..(557): a, c, t, g, unknown or other
  misc_feature (557)..(557): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaacgccctatagtggcaacncggcttgccagagtccaaggcagagttagatgaccaggagcaccctccccaggtacagtctacntggaactgagcagcctgagatctggacggaccacgggtcctgtactttctgtgcgagacgacccaccagccaccctggctgacttggtcggggccacggggacccctgggtccaccgtcctcctcacgcctcccgacccgaaacgggccccaacttccgggtccctttccccccgnggtcccncccctgaccctccgacggacgccaacccgtccgaagcgcacacggccgtcccngggtcccg

SEQ ID NO: 350312 - DNA, 697 bp, Homo sapiens
  misc_feature: GZ8MTXP02HWZBK.44.78.H01.1.454.CMB.2.raw
  modified_base (316)..(316): a, c, t, g, unknown or other
  misc_feature (316)..(316): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttggctgagctggtattttccttgctgcttaattttaaaaggtgtccagtgtgaggtgcagttggtggagtcgtgggggtaggtttaggtaaagccgtggggagtcccttagactctcctgtgcagcctctggattctactttcagtaacgcctggatgaccgtgggtcccnccgaggcctccggagggaggggctgggagtggggttcggaccgttagttaaggaaaccaagtcgtaggacggtgggacaggcaaggtacgtaccgctcggacgtaccccggtaggaaacggcaggtacttacccaccatctacaaagatagtagtaattaacgaaaagtacgttacggtactccgttctacggactaagaacgtacgaacgacgtaccctacggaaaacccgaaccggaacggaaccaaccgtaccgtaccggtactttaaacgttacgttacgggttaacgttcggggtacgttttcgggtttaccgtaacggtttcccggggacccggtaacggggtaacccccgttcgggtaccctacccggttcccg

SEQ ID NO: 350313 - DNA, 821 bp, Homo sapiens
  misc_feature: GZ8MTXP02G97OM.44.78.H01.1.454.CMB.2.raw
  modified_base (241)..(241): a, c, t, g, unknown or other
  misc_feature (241)..(241): n is a, c, g, or t
  modified_base (288)..(288): a, c, t, g, unknown or other
  misc_feature (288)..(288): n is a, c, g, or t
  modified_base (315)..(315): a, c, t, g, unknown or other
  misc_feature (315)..(315): n is a, c, g, or t
tcagacagtatatacacgaccggtgctcgatttagtgtgagtagtttgggtttgggggaagaggaagactgacggtcctgccacaggtggtgctgggcacggtgggcactcgactcaacaaccacatctgtcctctagagaaaaccctgtgagcacagctcctcaccatggactggacctggagatcgtcttcgttggtggcagcagctacaagacgcccactcccgaggtacagctggtncaggtcgtggggctggacggtagaaggacgccgtggggcctgaggtnacagtcctcgtgccgacggtctttcgnggtaactaccgtacgtttaccaatttaccgtaaatttagtacgtaaatttaacgttaaaccgggttggggtacccgtacccggaaaccggtaccgggtcccccgtaggggttaacgggaaaccgggtacggggggtccgttaaggggggtacgggttaggggtaacggggtttagggggaattaccgggggtaaagttaccggggaaaacccgtttacccggtaagggttacgggtaaccggtaaccgtaaacccgggtaccgggggtttactttaacccgggaccgtaaacgggtaaaccggtttacccggaaaaggtacgttaaaggtaacggttttaaggaagttacccgggaaaccgtaggggaacccctacccgtacccccggttaacccggtaggtaaccgttacgtaaacctacggtacggtaaacggaacgtacggaaccgaccgtacggtaaccgtagtaaccgtacgttaggaccggtaacggaccgtttaccggg

SEQ ID NO: 350314 - DNA, 728 bp, Homo sapiens
  misc_feature: GZ8MTXP02HY1IL.44.78.H01.1.454.CMB.2.raw
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacgagggtccgggcctcctctgacctgactcagccatcctcactcgtccgtcgtccccaggacacacagtcactattacctgctcgtagggaaacttgagtagtattaattgtcttctgtatcagcagcgcaggccacgcccctatcgctggtcattcttacaggataaagtaacggccggtccctacggacgggtactcccgtaggacgtccgtcttcctccgtcggtacccttacccgaaacgttcggtacgggaaaccgtacccggggcccttaaccgtccgttaccgaaccctacgtacaaccggcccgacccgaaccccgaagccccgttacgacggtaagtcggaacggtacctacggtaaccttacgtttaacgtcggtttacgaaacgggttacgggtaacgggggttaaaagtcggttaacggtttaaaggttcgggggtttacgggttacggggacggggaacgggtaacgaacggtcgtacgggttaaccgttcgttacgggaccgtaccggacccgtaacggtccgtcccggtaccccgttcggtacctaccgttccgtttcccggttaccccgtccccg

SEQ ID NO: 350315 - DNA, 720 bp, Homo sapiens
  misc_feature: GZ8MTXP02GD60X.44.78.H01.1.454.CMB.2.raw
  modified_base (402)..(402): a, c, t, g, unknown or other
  misc_feature (402)..(402): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcaatgacagtctcctgcacggcttctggatacacgttcatcaattatgatattaactgggtgcgacaggccgctggacaagggctggagtggatgggatggatgaacgccctagtagtggacaacgacgggtctttgcccagaacgttccaaggcagagttagtagtcgaaccgaggacgccaccctccccgaggtacagtcacagtggaactgagtacacgtcctgagatcgtaggacggaaccgtacgggccgttagttactttcgnggtcgacggaagacgcccacgaacgcccaccgttgggtcctttaggtaaccgtttggggaccgggggacccgtaaacgggggtaacccttcggggtaccctacccgggtttccctcccttcgaaacccgtccccgtaacccccgaaccgggaaacccggggtccccctaacggtttccccggtcccccgttttcccccgggcgggtcccccgccccgtttccggccccgttaccggaacgggtaccgtacccccgacccgtaccggaacgtaacgacccaaaccgggcccgggccccggttacccggcgggttccccg

SEQ ID NO: 350316 - DNA, 757 bp, Homo sapiens
  misc_feature: GZ8MTXP02JZPR7.44.78.H01.1.454.CMB.2.raw
  modified_base (313)..(313): a, c, t, g, unknown or other
  misc_feature (313)..(313): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaacgtgggtgcgacaggccgcgtggacgaagggcgtggaggtggagtgggatggatgaacgtcctagtaggtgacaacgcggtcttcgaccagacgtcgaaggcagtagttagtatcgacgaggacnccaccctacccgaggtacacgtactaacgagtacggactgacgacgtacgacctaggaagtcgtacggtaggacgggaccgtaccgggttccgttagtttacgtttcggtaggtacgacggtaacgacccgacccgaaaccgcgacccgtacccggtggttccgtttaggggtaaccggtttcgggggaaacccggggtacccggtaaaccgggggttaacccccgttcgggttaccccgttacccccgttaccgtcccgtaccgacccccggtccccgtaaaccccgacccgggaaccggtaccccctacggttcccccggtttacccccgtcccccggtcggcccccgtccccgtaggtaccccgccggaacgggccctaaccccgacccggtaccgaaggacccgcgacccggaccggccccggtacgggtcggtacccgg

SEQ ID NO: 350317 - DNA, 590 bp, Homo sapiens
  misc_feature: GZ8MTXP02JGYUJ.44.78.H01.1.454.CMB.2.raw
  modified_base (301)..(301): a, c, t, g, unknown or other
  misc_feature (301)..(301): n is a, c, g, or t
  modified_base (372)..(372): a, c, t, g, unknown or other
  misc_feature (372)..(372): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcacttattacctgctcgtaggggaaacttgagtgaataaatttgcttcctggtatcagcagacggccaggccacgccccctatcgctggtcatcttnaggataataacgccgcctacgacgggactccgtgagtcgtacttctccgtcgcctaccactcgtacggacnccggccactctcgaccatcacgccgacgacccacgtcctgtggactcggaggtctagacttagttactggtacacggtacggtagggaaagtcgtacgttaaggtgggttgggttacgggcggaacgggacgaaggccgttacggaccgttccgacggtccacggacccgaacgccgtcgcccccgttcggtacctccgtctccgttacccctacccg

SEQ ID NO: 350318 - DNA, 725 bp, Homo sapiens
  misc_feature: GZ8MTXP02H3GPE.44.78.H01.1.454.CMB.2.raw
  modified_base (392)..(392): a, c, t, g, unknown or other
  misc_feature (392)..(392): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtaggggaaaacttgagtgaattaaattgcttctggtactcagcagacggccaggccacgcccctatcgctggtcattctttcgaggtataacgtaacgccgcctagaagggtctcccgtgacgtccgtcttcgtccgtcggtccctaccgaaacgttcgtacggggaaacccncgggtccctaacgtccgtacgaacctaacgcgaacggcccgacccgtacccgacggtccctacggtacgggtaattcgggaacgggtcctaacggtaactttacgttaaaccgtcggttaaccgaaggggttaacgggtaaggggtaaaagttcggtaacgttaaagggttcgggggttcggtaccgggggtaccgggaagggtacccgaaacggtcgtaccgggtacccggtttccggacggggtaccaccgggtacccgaacggtcccgtaacccggtccccccgttacggtaccctccggttacccttcccgtttacccccgtaaccccc

SEQ ID NO: 350319 - DNA, 799 bp, Homo sapiens
  misc_feature: GZ8MTXP02GLJBA.44.78.H01.1.454.CMB.2.raw
  modified_base (207)..(207): a, c, t, g, unknown or other
  misc_feature (207)..(207): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctgggcctcagtgacagtctcctgcacggcttctggatacacgttcatcaattatgattattaacgtgggtgcgacaggccgntggacgaagggtctgggagtgggagtgggatggatagaacgtcctaagtggtcggacaaacggtcggtctttacgaccaaagtacgttaccgaaggctaaggtagttagtatacgaccgaggacgccgtaccctaccgaggtaacctgtactaacagttacggaactgacgtcacgtcagtacgactcgtagaacggaccgtaccgggtcgtttgttaacttttcggtagttaggacggtacggaccgttacccggaaccaaggtcccgtaccggttacggtcgttttacggaccggtttccgggggtaccggggaaacccgtaacccgggggtaccccgtttaacgggtccccgtaaccccgggtttaccccgtttccccaaccggttaacccggcccccttaaaccccgaaccgggtaaaccccggggtccctaaacccggtttcccccggtttcccccgtttccccccgggaaggtttcccccgccccgggtttcaaacccccgggttaacgcccggggttacgaacccccaccggttaccccgaagaccgaccttaacccgggcggacccggtccgtaacggtcccgg

SEQ ID NO: 350320 - DNA, 781 bp, Homo sapiens
  misc_feature: GZ8MTXP02FUEZF.44.78.H01.1.454.CMB.2.raw
  modified_base (409)..(409): a, c, t, g, unknown or other
  misc_feature (409)..(409): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacgaggggtccggggcctcctctgacctgactcagccatcctcactcgtccgtcgtccccaggacacacagtcactattacctgctcgtaggggaaacttggagtagtaattaaatttgctttcgtggtatcagcagacggccacggccacgtccccctatcgctggtctattcttcgaaggtaataaagacggccggtaccctacggacgggtacctcccgtagacgtcgtccttctccgtcggtcctaccgtacgtcgtacggggaacccnccggggccacgttccgaccgacctatccgaccgacccgacccgaccccgacgtccctacggttaggaacgtcgggtacggcgttacggtaaaccttacgtttaaaccggttcggtaacccggttaagggtaacggggttaacggggttaaagggtacgggttaaccgtttaaaggggtttcgggggttaccggggtttacgggggaccggggaaacggggtaaaccccggaaagggttcccggtttacgggtaacccggtttccggtaccgggttaccgaccgggtaacccggtaacggtcccggtaacccccggtcccccggtaccgggttacccaccgtttccccgtcccggtttcccccgttaaccccg

SEQ ID NO: 350321 - DNA, 619 bp, Homo sapiens
  misc_feature: GZ8MTXP02GQ4O8.44.78.H01.1.454.CMB.2.raw
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaacgtgggtgcgacaggccgctggacaagggctggagtggagtgggatggatgaagccctagtagtggacaacgacggtcttcgcccagaacgttccaaggcagagttagtatgaccgaggacgccacccgtccccgaggtacacgtactacagtacggaactgagcacgcctagagatcgtggacggacgacgggcgttgttactttcgtgtcgacgagacgacccaacgacgccacgtggtcttgacgtttcgggacggggaccgacgggacccgtggtacctaccgtctccgcaccgtccctacccgaccgaaccgggccctacgttcccggtaccccttccccgcggcccgtcccgtcgcccgtaccgacggtaccgacccacccgtacgaacgacaccgacgaccggcccggtcccggttcggcccg

SEQ ID NO: 350322 - DNA, 626 bp, Homo sapiens
  misc_feature: GZ8MTXP02IKBOQ.44.78.H01.1.454.CMB.2.raw
  modified_base (337)..(337): a, c, t, g, unknown or other
  misc_feature (337)..(337): n is a, c, g, or t
  modified_base (360)..(360): a, c, t, g, unknown or other
  misc_feature (360)..(360): n is a, c, g, or t
  modified_base (600)..(600): a, c, t, g, unknown or other
  misc_feature (600)..(600): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgattattaacgtggggtgcgacaggccgcgtggacaagggctggagtggagtgggatggatagaacgcctataggtgacaacgcggtcttgcccaagtaagtccaaggcagagttagtatgaccaggacgccaccctccccgaaggtaccagtctanagtaggaactgagcagcctaganatcgtaggacggaccgcgggtccgttgttacgtttcgtgtcggcgtagacgcccacgacgcacgtggtcttcgtacgttgggtacggggccgacggggtaaccccgtggtcccgtaaccggtccttcccgtacgtaccgtcccctacccgaaccgtaacgggcccctacgttcccggttccccgttcccgtcggcccgtcccgtcgccgtccgacggccgcccgaccgtaccgaacgacncgacgacggcccgtaccggcggtccg

SEQ ID NO: 350323 - DNA, 592 bp, Homo sapiens
  misc_feature: GZ8MTXP02GE5OP.44.78.H01.1.454.CMB.2.raw
  modified_base (289)..(289): a, c, t, g, unknown or other
  misc_feature (289)..(289): n is a, c, g, or t
  modified_base (338)..(338): a, c, t, g, unknown or other
  misc_feature (338)..(338): n is a, c, g, or t
  modified_base (372)..(372): a, c, t, g, unknown or other
  misc_feature (372)..(372): n is a, c, g, or t
  modified_base (387)..(387): a, c, t, g, unknown or other
  misc_feature (387)..(387): n is a, c, g, or t
  modified_base (406)..(406): a, c, t, g, unknown or other
  misc_feature (406)..(406): n is a, c, g, or t
  modified_base (420)..(420): a, c, t, g, unknown or other
  misc_feature (420)..(420): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacgagggtccgggcctcctctgacctgactcacgccatcctcactgtccgtcgtccccaggacacacagtcactattacctgctgtagggaaacttgagtagtaattaaattcgcttcgtggtatacgagcagacgtcagcccacgcccctancgcgtgtctattcttgagtataatacggccggtcctagacggactccgngacgctcgtctcgcgtcctacacgtcgacggacncgccactcgacaccntacgacgtcgaccgacccncgaccttgacggancggacgtacgtgaaccttagtacgtgtaacgacgggtacgtaagggtaagtgtacgttaggtgggttacggtacggacgggtacgacgacgtcgtacggtccgttacgcggaacgtcgaccgtcgtcctccggtaccccgtcgtacctccgtccttcccgtacccttacccg

SEQ ID NO: 350324 - DNA, 732 bp, Homo sapiens
  misc_feature: GZ8MTXP02IJFX9.44.78.H01.1.454.CMB.2.raw
  modified_base (264)..(264): a, c, t, g, unknown or other
  misc_feature (264)..(264): n is a, c, g, or t
  modified_base (302)..(302): a, c, t, g, unknown or other
  misc_feature (302)..(302): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgattattaacgtgggtgcgacagggccgcgtggacgaagggctggagtggagtgggatggatgagcctatgtgacaacgcggtnttgccagacgtcaggcagtagtagtatcgacgaggacnccacctacccgaaggtacacgtactacagtacggtaaactcgaacgcgacgtccgtagaacgtatacgtaggaacggtaaccgaccgggtccggttagtttacgttttcgtacgggttcgacggaacgaccgacccgaaacgacgtacccgtaaccgttcgggtaaccgtttcggtaaccgggttttcgggggacgggggtaaccccgggtaaaccggggtacccgttacgggtaccccgtaaccggtttccctacccgttaccgacccggtaccccgaacccggtaaaccggtaccggggaccctacggttccccgttcccccgttaaccccgtcgggcccctcctccggacccgttaccggacggaccgacccgtacccggacgaacgggactaccgaccggaacggccccggtacggtcggtcccgg

SEQ ID NO: 350325 - DNA, 745 bp, Homo sapiens
  misc_feature: GZ8MTXP02JM82W.44.78.H01.1.454.CMB.2.raw
  modified_base (633)..(633): a, c, t, g, unknown or other
  misc_feature (633)..(633): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaacgtgggtgcgacaggccgctggacaagggctggagtggatgggataggatgaacgcctagtaggtggtacaacgtacgggtctttcgaccctaggtaacgttcccgaaggcctaaggtagtttacgtaagtacggaacccgaagggacgtacccgtaccccgttacccccgaagggtaaccacggttacctaaccgagtacggaacttcggacgaccgtacggaccttaggaacgtatacggtaggaaccgggtacccgtaccgggtccgttagttacgtttcgtagtcggtacgtaacggaccgccccaacgacgtacctaccggtcgtcgttacgtacgttcgggcggggtacccgtaacggggtacccgtcgggtaccctaccgtccgttcccgtaccgtccgtacccgtacccgaaccgaaccggtccccgtaacgttcccggtccccttacccccggnggtcccccgtccgcgtacccgtccgacggtccgacccgtacccgacgacgtaccgaccgaaaccgcggaacccgggtcccgtcgggtcctcggcccgtacggtacgtaaccg

SEQ ID NO: 350326 - DNA, 669 bp, Homo sapiens
  misc_feature: GZ8MTXP02JZBFA.44.78.H01.1.454.CMB.2.raw
  modified_base (304)..(304): a, c, t, g, unknown or other
  misc_feature (304)..(304): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacgcggtcttgacccagaacgttccaaaggcagagttagtatgaccaggacnccaccctcccgaggtacacgtcacgagtacggaactgacgacacgacctgagactcgaggacggacgacgggtccgttagttactttcgtggtgcgagacgacccaacgcgacgtaccgttgggtcttaggtaccggtttgggaccgggggacccgtacgggggtaaccccgttgggtaccccgtaccggttccctccgtaccgaccgtacccaccccgaaccggaaccggggtcccctaacgttcccccggtcccgtttcccccggcggcccccgtcccgtcgccctacccggaacggtacccgacccgtaacccgacccgaaggacccgacgaccgaccggcccggccccggtagggtccccg

SEQ ID NO: 350327 - DNA, 668 bp, Homo sapiens
  misc_feature: GZ8MTXP02JWD4H.44.78.H01.1.454.CMB.2.raw
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgattaattaacgtgggtgcgacgagggccgcgtggacgaagggcgtagggaggtggagtgggagtggaatgaacgcctaagtaggtggacaacgacggtctttcgccagaagttccaaaggcaaggtagttagtatacggaaccgaggacgaccctaaccccgtacccccgtaaggtaacgacgttacctaacgagtacggaactcgaagtccaggtaccgtagacgaagtccgtaggaacggaccgaacgggtccgttggttaactttcgtggtcgacggagacacccaccgacgccgacgtggtctaggtacgtggtacgggcgaacgggtaccgtcggtcctaccgtctccacgtcgaccctaccgaccgaacggtcccgacttcccgttcccgtccccggcggtccccgccctcggccctacggacggtacctccccgacctaccggaacgaccgacaccgaccggccgtcccggcggtacccg

SEQ ID NO: 350328 - DNA, 814 bp, Homo sapiens
  misc_feature: GZ8MTXP02JL0WK.44.78.H01.1.454.CMB.2.raw
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaacgtgggtgcgacgaggccgctggacaagggctggagtggagtgggatggatgaacgtccctaagtaggtggacaacgtacgggtcctttgccctaagaacgttaccgaagggcaaggtagttagtaagtcgaaccgaggacgaccaaccccgtcccgaggtacctagtcgtaaccaagtcggaactggacaccgtaacgtccgtacggagtactacggtacggaacggaaccgacccgggttccggttgttaagtttccgtgggcgtacggaaagtaccgacccgtaaccgacgtacccgtacgttcggttcccgtttagttaacccggggtttggggacccgggggttaacccgaaacccgggggttaaccccgtttccggggtaaccccgttaacccgggtttccccttacccgggttaccccaccgggtacccccttaacccccgaaaccccggggaacccggggtacccctaccggtttacccccgggttacccggtttccccccggcggttccccggccccctttcggggaccccttaccggaacgggggtaccccaccgtaccccggtaaccgaacgtaacggcccaaacggtccggcccccggttccgggacggtcccg

SEQ ID NO: 350329 - DNA, 836 bp, Homo sapiens
  misc_feature: GZ8MTXP02HI9YJ.44.78.H01.1.454.CMB.2.raw
  modified_base (319)..(319): a, c, t, g, unknown or other
  misc_feature (319)..(319): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaacgtgggtgcgacaggccgctggacgaagggctgggagtggagtgggatggatagaacgcctaagtaggtggacaacgacgggtctttcgacccagaacgttaccaaggcaagagttagtatgacgaggacnccaccccgtcccgaaggtacacggtactaacgagttaggaaactggaacgactacgccgtagacgtatcgtaggacggaccgtacgggtccgttagtttacgtttcggtacggttacggaccgggaggtacccggaccccctaaaccggaaccggtccctaaccccgggttgggttaacccgtttcgggttaaccggttttcgggggtacccggggggaaccccgtaaaccgggggttaacccccgtttcgggggaaacccccttacccggggttaccccttttcccgaaccggttcccggaccccctttacccccggaaaaccgggtaacccggggtccccctaacggtttcccccgggtttccccgtttcccccccgcgggggtccccctccccgttaaacgggttcccccgtaccgggaacggggtaacccccgtccccggtaaacccggtcggaacccggaccgacccggtacccgggcccggggtaccccggtcccgggttaccgggtcccg

SEQ ID NO: 350330 - DNA, 785 bp, Homo sapiens
  misc_feature: GZ8MTXP02FM1CS.44.78.H01.1.454.CMB.2.raw
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacgaagggctggagtggagtgggatggatgaacgcctaagtagtggacaacgacgggcttcgcccagaacgtccaaggcagtagtagtatcgacaggagccaccctccccgagtacagtctacagtaggaactgagaccagctagagtactcgtggacgacgaccggcgttgttactttcgtagtcggacgagacgcccaaccgacgccaccgttggggtctttacggtacggtttggggcgggggacccgtaaacccgggggacccgttggggttacccctaccccgggtttcccttacccgtacccgaccggtccccccttaaccccggaaccccgggaaaccggggttcccccctaacggtttccccccgggggttcccccctttcccccccgggacggggttccccctaccccccgtttcgggaacccccttaccccgggggaaaacggggcccccttaccccggacccccgttacccgggggaaaccgtaaccccgccccggaaaccgggttcccggcccccgggggccccgtttcggggggtcccctaccggtaccccggtttacggggaaacccggtttaaaaccgg

SEQ ID NO: 350331 - DNA, 604 bp, Homo sapiens
  misc_feature: GZ8MTXP02I9811.44.78.H01.1.454.CMB.2.raw
  modified_base (495)..(495): a, c, t, g, unknown or other
  misc_feature (495)..(495): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacagggccgctggacaagggctggagtggatgggatggatgaagcctatagtggacaacgacgggtctttcgcccagaagttccaaggcagagttagtatgaccaggagccacctccccgaggtacagtctacataggactgagcagcctagagatcgtagacggtacacggtccgtgttatttcgagtgacgaggacaccaccgagcacgtggtcttgacgttgggtacgggacccgaagggtaccctggtcctacccgtctcctcgacgccctacccgaaccgacgggccctagtcccggttccccttccccgnggtcccgcccttgccctaccgacggcgacccacccggtcgacgacgacccgacgaccggccccggtccgtcggggcccttccggtaccgtacggggtacctaaaaccgg

SEQ ID NO: 350332 - DNA, 615 bp, Homo sapiens
  misc_feature: GZ8MTXP02IN95S.44.78.H01.1.454.CMB.2.raw
  modified_base (297)..(297): a, c, t, g, unknown or other
  misc_feature (297)..(297): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
  modified_base (470)..(470): a, c, t, g, unknown or other
  misc_feature (470)..(470): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagccatcctcactcgtccgtcgtccccaggaccactaccagtccaacttacttacctgctacggtaggggtaaaacttgagtagtaattaagtttgtcttcgtggtactcagcaggacgccgacggccacncccctagtcgctcggtcacgtttctttacgaaggtaactaaacggtaaccggtcccggccccgttagacgggttactccccgtagaccgtccgtcttcgtccgtcgcctacgtaactcgacgggaacccnccggccncgtcacactancgcgccnccgaccncgtcngngagngactacactactacttacgtcgtagtgtagtagagtagtacgttaggttgggtcgtacgggacggacggacgcgtcgtacgtccggtcgtaccgacgaccgaccgccgcgtcccgtcccgtcgtcctccgtcctccgtaccctcg

SEQ ID NO: 350333 - DNA, 839 bp, Homo sapiens
  misc_feature: GZ8MTXP02FYF74.44.78.H01.1.454.CMB.2.raw
  modified_base (196)..(196): a, c, t, g, unknown or other
  misc_feature (196)..(196): n is a, c, g, or t
tcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaacgtgggtncgacaggccgctaggacaagggctggagtggatgggatggatagaacgccctataggtggacaacgcggtcttcgaccagaacgttaccgaggacagtagttagtatcgaccgaggacgccacccgtaccccgagtacacgtactacgtacgtaggaactggacgcgacgccgtaggaagctacgtaggacggaaccgtacgggtccgttagttactttacgtgggtacgacgacggtacccgacccaaaccgacgtacccgtaaccggttcggtaacctttgggaaccgggtttcggggtaccgggggaacccgtaaccgggggttaacccccgttccggggtacccgtaaaccccggggttcccttcccccggttacccgaaacccgggtcccccttaaccccggaaaccccgggttaacccgggggtccccgttaaaccggtttcccccgggtttaccccccgttttaccccccgggcggggtaccccccgttcccccggtacggttacccccggtaacccgggaacgggtaaccccggccccggtaacccccgttacccggggaaacgtaccccgggggtacccaaaaccggggacccgggggttccccggtaccccgggggtttacgggggtcccccg

SEQ ID NO: 350334 - DNA, 684 bp, Homo sapiens
  misc_feature: GZ8MTXP02H8SDA.44.78.H01.1.454.CMB.2.raw
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacgacggggtccgggcctcctctcgacctgactcacgccatcctcactggtcccgtcgtcccagacacacagtcactacttactgctcgagggtaaactgagtagtattaagttgtcttcgtaggtatcgagtacgaggacgaccgacggcccaccggtcccctaagtcgtacgtcggtactacttcctttacgaacgtaataaacgtaacggtccggtaccgtacggacgggtacctccgagaccgtcgtacttcgtcgcggtacctaccgacgttcgaacggaaccgccgacctacgtaccgtacgactacggtacacgcccgaccgaccgacgtccgtacggcgtagcgtacgtgtacgttaacttacgttacgtagtacgaacggtacgggtaacgtaaggtacgtagttaaggtcggggttacgtacgggggaggaacggtacgtacgtcgtaccggtacgttcgaccggagtaacccggaccgtaggtcccgtcccggtaccgtaccggttactaccctaccggtttacccgtacccctccc

SEQ ID NO: 350335 - DNA, 694 bp, Homo sapiens
  misc_feature: GZ8MTXP02F86OJ.44.78.H01.1.454.CMB.2.raw
  modified_base (293)..(293): a, c, t, g, unknown or other
  misc_feature (293)..(293): n is a, c, g, or t
  modified_base (630)..(630): a, c, t, g, unknown or other
  misc_feature (630)..(630): n is a, c, g, or t
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaatttatgattattaacgtgggtgcgacaggccgctggacaagggctggagtggagtgggatggatgaacgcctatagtgacaacgacgggtcttgacccagaacgttccaaggcagtagtagtatgaccgaggacnccaccctccccgaggtacagtctacagtaggaactgagtcacgtcctagagacgtcgtaggaacggacgacgggtccttagtttactttacgtggtggaccgaggaccgacccgaccgacgaccgtacccggttggggtacctttagggaccggtttgggggacccgggggtcccgtaaaaccgggggtcccctttgggtaccctacccggttcctcccgtaccgaccgtccctaccccgaacggacccgggtcctacggttccccggtccccttccccggtggacccctccctacggccccgtaacggacgggtccacccggttacccgacggaancccgaccaaccgccggggccccggtccgtcggggtcctccgtacggttacggtacctaaccggg

SEQ ID NO: 350336 - DNA, 679 bp, Homo sapiens
  misc_feature: GZ8MTXP02GVBU1.44.78.H01.1.454.CMB.2.raw
  modified_base (197)..(197): a, c, t, g, unknown or other
  misc_feature (197)..(197): n is a, c, g, or t
  modified_base (301)..(301): a, c, t, g, unknown or other
  misc_feature (301)..(301): n is a, c, g, or t
  modified_base (312)..(312): a, c, t, g, unknown or other
  misc_feature (312)..(312): n is a, c, g, or t
  modified_base (341)..(341): a, c, t, g, unknown or other
  misc_feature (341)..(341): n is a, c, g, or t
  modified_base (402)..(402): a, c, t, g, unknown or other
  misc_feature (402)..(402): n is a, c, g, or t
  modified_base (569)..(569): a, c, t, g, unknown or other
  misc_feature (569)..(569): n is a, c, g, or t
tcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaacgtgggtncgacaggccgctggacaagggctggagtggatggatgatgaagcctatagtggacaacgacgggtcttcgaccctagaacgttccaaaggcaagagttagtacngaaccaggacnccacccgtacccgaggtaccagtcctaanagtaggaactgagcgaacgtcagaatctcgacgaggaccacggtccgtagtacttcgtagngacgagacgaccacgagtccacgtggtcttacgaccgttggacggggactaacggggtacccttaggtacccgtaaccgtcctttccgacgaaccggtcccctaacccgaaacccggtaacgggggcccccctaaggtttcccccggtaccccgttttaccccccgngggggcccccgttaaaacccccgtcggtacccgtaccggaacggtaccgtacccgtaacccgtacggaacgaccgaccgaccggccgggcccggtttccggaacggtccg

SEQ ID NO: 350337 - DNA, 703 bp, Homo sapiens
  misc_feature: GZ8MTXP02ILAOK.44.78.H01.1.454.CMB.2.raw
  modified_base (188)..(188): a, c, t, g, unknown or other
  misc_feature (188)..(188): n is a, c, g, or t
  modified_base (268)..(268): a, c, t, g, unknown or other
  misc_feature (268)..(268): n is a, c, g, or t
  modified_base (299)..(299): a, c, t, g, unknown or other
  misc_feature (299)..(299): n is a, c, g, or t
tcagacagtatatacacgaccggtgctcgatttagtgtgagtagtttgggtttggggagctctgggagaggagccccagccttgggattcccaggtgttttcattcagtgatcaggactgaacacagaggactcaccatggagtttgggctgagctggatttttccttgctgcttaattttaaaggtntccagtgtgaggtgcaggttggtggaggtcgtgggggaggtttaggaaagccgtggggacgtccttagacctctcctgtncagtcctctggtactctactttcagtaaccnctgggactcgaccgtcggggtccgccgaggcctaccggaaggggacggggtcctggggtacggttggggttcggtacccgttagttaacgaaacccgtaaaaggtcgtaacgggtacgggtcggggaccaggacgacgacttaccggcgtcgggaccctaccccgggtagaaacggcctagacttaccacctatacctacgaagagtaatacgtaaataaacggtaaaagtaacggttacgggttaacttcggttaccgagtaccgtaaagtaacgttaggaaaccacgaccggttacgaaaccgaaccggaagactaccgacgtaccgttactacttcggtcgtaggttgtacgttggttcaaggttcccgggactaaccgggtcctcggtcctacggtaccc

SEQ ID NO: 350338 - DNA, 797 bp, Homo sapiens
  misc_feature: GZ8MTXP02GA4L8.44.78.H01.1.454.CMB.2.raw
tcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacagggctggaggtggagtgggagtggatgaacgtcctagtagtggcaacgcgggtcttgcccagaagttcccaaggcagtagttagtagtgaccaggacaccaccctccccgaggtacacgtctacagtaggaactggacgtcgacgtaccgtacgagagtcgtacgggaccggacccggaccggtaccggttagtttacgtttcctaggttcggaccgaacgaccgtacccccgaaccgacggtaccgtaacccgttgggtctttacgggtaacgttttcggggtcgggggacccccgggtaaacggggtacccccgtaaggggttccccgttaaccccggtcccttacccgtaccccgtacgttcccccgtaaccccggaaaccggaaaccccggggtcccctaaccgtttcccccgggttcccccgtttaacccccccggtcgggtcccccggtaccccggttccgtacccgtacccggaaaacgggttacccgcccccgtaaccggacccgggacggttaccgaccgtaaccggaccggccccgggtaaccggtttccggggacccggtcgttacccggtacggtacccggtttaaaccgg

SEQ ID NO: 350339 - DNA, 817 bp, Homo sapiens
  misc_feature: GZ8MTXP02FMTCR.44.78.H01.1.454.CMB.2.raw
  modified_base (323)..(323): a, c, t, g, unknown or other
  misc_feature (323)..(323): n is a, c, g, or t
  modified_base (395)..(395): a, c, t, g, unknown or other
  misc_feature (395)..(395): n is a, c, g, or t
tcagacagtatatacacgaccggtgctcgatttagtgtgagtagtttgggtttggggctgggcctcaggaagcagcatcggaggtgcctcagccatggcatggatccctctcttcctcggcgtccttgcttactgcacagggtccgggcctcctctgacctgactcagcccatcctcactgtccgtgtccccaggacacacagtcactatacctgctagtagggaaaacttgagtgtataaatttgcttccgtggtatcagcagaggccaggccacgccccctatcgacgtgtcattcttcaaggtataataagcggtccctnacggggtactacccgttgacgcgtaccttcgtacccgtcggtacctactaaaccgttcgtacggggtaaacncccggggtacccaacgtttacccgaccggtaaccctaagttaccaaacgggtacccgtacccggaaacccccgtaaacgggtcccctaccggttagggaacgtaccggggtaggttaccctagggttaaaccgtttaaactttaacccggttaggtaacccgtaaccggggtaacgggtttaaaccgggggaaaaacggttggtaaacccgttaaaacggtttgggggtttaacgggtttaccgggggccgggtaaaacgggggtacccgaaaacggggtacccggttacggtaccccggtttacggttacccggggttaaacccgaccgggaaccccggtaaaacggtcccggtaaccgtacccccccggttacggtacccgaacgtttacccggtacccgtttcccccgggtaacccccc

SEQ ID NO: 350340 - DNA, 511 bp, Homo sapiens
  misc_feature: GZ8MTXP01C69PM.19.59.F04.1.454.CMB.2.raw
  modified_base (484)..(484): a, c, t, g, unknown or other
  misc_feature (484)..(484): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctgggtggagtcgtgggggaggcttggtacagcctgggagggtccctgagactctcctgtgcagcctctggattcaccttcagtagttatgaaatgaattggggtccgccaggctccgaggggagggctggagtgggttcatacattagtagtagtggtaagtagcatatactacgcagactctgtgaagggccgattcaccatctcagagacagcgccaaggactcactgtatctgacaaatgaaacagcctgaagagccgaggcaacggcttagtttnttacgtgtgcgagagagtggctaaggg

SEQ ID NO: 350341 - DNA, 518 bp, Homo sapiens
  misc_feature: GZ8MTXP01APUKZ.19.59.F04.1.454.CMB.2.raw
  modified_base (230)..(230): a, c, t, g, unknown or other
  misc_feature (230)..(230): n is a, c, g, or t
  modified_base (247)..(247): a, c, t, g, unknown or other
  misc_feature (247)..(247): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaaanattgggaataattttgngtcctggtaccagcagctcccaggacagccccaaatcctcattttgacaataataagcgaccctcagggattcctgaccgattctctggctcccaagtctggcacgtcagccaccctgggcatcaccggactccagactggggacgaggccgattatactgcgaacatgggatagcagcctgagtactgtgataagtcggcggaggaccaagctgaccgtcaggtcagcccgaggcctcgcccctggtccacgttctcgttccccaacccc

SEQ ID NO: 350342 - DNA, 638 bp, Homo sapiens
  misc_feature: GZ8MTXP01EFTRO.19.59.F04.1.454.CMB.2.raw
  modified_base (230)..(230): a, c, t, g, unknown or other
  misc_feature (230)..(230): n is a, c, g, or t
  modified_base (268)..(268): a, c, t, g, unknown or other
  misc_feature (268)..(268): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctaccaanagttagggaatattttgtcgtcctggtaccagcacgcncccaggaacacgaccccaaactcctctattttcgaactaaataataacgccgtaaccctacgacgggtacttcccgtacgaccgtattcctcgtcggcctaccccaagtctcggcacgtcacgcccacccgtcgggcacgtccgaccggactccgacgacgtacggggacgacggaccgtaagtttacgttacgtacgacggaacagtagggaatacgcgtacgccgtagacgtacgtgtagtaagtaacggtcgggacgggtaacggaccgaagtaaccgtacggacccgtacgacgtaccgaaccgaccgacggttcccgtcccgtccccgtcggtcctacccgttccgttcccgttccccgtccccg

SEQ ID NO: 350343 - DNA, 540 bp, Homo sapiens
  misc_feature: GZ8MTXP01EVDR3.19.59.F04.1.454.CMB.2.raw
  modified_base (246)..(246): a, c, t, g, unknown or other
  misc_feature (246)..(246): n is a, c, g, or t
  modified_base (314)..(314): a, c, t, g, unknown or other
  misc_feature (314)..(314): n is a, c, g, or t
tcagtactctcgtgcacgaccggtgctcgatttagtacacacacttagggattgggggcagaaggcaggactcgggacaatcttcatcatgacctgctcccttctcctcctcacccttctcattcactgcacagggtcctgggcccagtctgtgttgacgcagccgccctcagtgtctgcggccccaggacagaaggtcaccatctcctgctctggaagcagctccaacattgggaataattttgngtcctggtaccagcagctcccaggaacagcccccaaactcctcattttgacaataataagcgaccctnagggattccctgaccgattctctggctcccaagtctggcacgtcagccaccctgggcatcaccggactccgagacgtggggacgaggccgattacttactgcggaacatgggatagcgagcctgagtactgtgataaagtcggcggagggacccaaaggctcgacccggtcttaggtccagccccgaaggcctcgcccctcggtcacttctcgttcccctaacccc

SEQ ID NO: 350344 - DNA, 590 bp, Homo sapiens
  misc_feature: GZ8MTXP01DJ68Z.19.59.F04.1.454.CMB.2.raw
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaaacattgggaaataattttgngtcctggtaccagcagcncccaggaacacgcccccaaactcctctattttgaacaaataaataacgcgaccctcagggactttcctgaccgtattctctggctcccaagtctggcacgtcacgcccaccctgggcatccaccggactccagacgtggggacgaggccgtaattaacgttactggacggaaacagtagggatagcgagcctagagtactgtagataaagtcgggacgggacggaccgaaagcgtacggacccgtaccgttacggacacggacccgacggttccgtcccggcccccgtcggtcccaccgttccgttcccgttccccgtcccccg

SEQ ID NO: 350345 - DNA, 567 bp, Homo sapiens
  misc_feature: GZ8MTXP01CDHB1.19.59.F04.1.454.CMB.2.raw
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
  modified_base (246)..(246): a, c, t, g, unknown or other
  misc_feature (246)..(246): n is a, c, g, or t
  modified_base (314)..(314): a, c, t, g, unknown or other
  misc_feature (314)..(314): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggccccaggacagaaggtcaccatctcctgctctggaancagctccaanattgggaatattttgngtcctggtaccagcagctcccaggaacagcccccaaactcctcattttgacaataataagcgaccctnagggattccctgaccgattctctggctccccaagtctggcacgtcagccaccctgggcatcacgactccagacgtggggacgaggcccgattagttactgcggaacagtgggatagcagcctgagtactgtagattaaagtcgggacggagggaccgaaagcgtcgacccggtaccttagggtaccgacgaccccgaagggcctaaccggcccccgtcgggtccaccttccgtaaccgttcccctaacccccg

SEQ ID NO: 350346 - DNA, 547 bp, Homo sapiens
  misc_feature: GZ8MTXP01EB85P.19.59.F04.1.454.CMB.2.raw
  modified_base (219)..(219): a, c, t, g, unknown or other
  misc_feature (219)..(219): n is a, c, g, or t
  modified_base (246)..(246): a, c, t, g, unknown or other
  misc_feature (246)..(246): n is a, c, g, or t
  modified_base (316)..(316): a, c, t, g, unknown or other
  misc_feature (316)..(316): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagcccgcctcagtgtctgcggccccaggacagaaggtcaccatctcctgctctggaancagctccaacattgggaataattttgngtcctggtaccagcagctcccaggaacacgacccccaaactcctcattttgacaataataagcgaccctnagggattcctgaccgattctctggctccccaagtctggcacgtcacgcccaccctgggacactcaccgggactccagacgtggggacgaggccgatttactactgcggaacagtggatagcgagcctgagtactgtgataaagtcggcggaggacccaaggctggaccgtcgttagtcgacgttcccgaaggcctaacgccccgtcggtcacttctccgttccccgtcccc

SEQ ID NO: 350347 - DNA, 537 bp, Homo sapiens
  misc_feature: GZ8MTXP01AGV49.19.59.F04.1.454.CMB.2.raw
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
  modified_base (263)..(263): a, c, t, g, unknown or other
  misc_feature (263)..(263): n is a, c, g, or t
  modified_base (449)..(449): a, c, t, g, unknown or other
  misc_feature (449)..(449): n is a, c, g, or t
tcagtactctcgtgcacgaccggtgctcgatttagtacacacacttagggattggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaancagctccaanattgggaataattttgngtcctggtaccagcagcncccaggaacagccccaaactcctcattttgacaataataagcgacctcagggtattcctgaccgattctctggctccccaagtctggcacgtcacgcccaccctgggcactccaccggactccagacgtcgggacgaggccgtattatactgacgaaacagtgggatacgcgagcctgagtactgngataagtcggcggagggaccaagctgaccgtcacgtcacgccgaacggcgtcgcccctcggtcctacgttcctcgttccccgtccccg

SEQ ID NO: 350348 - DNA, 700 bp, Homo sapiens
  misc_feature: GZ8MTXP01BLS8Y.19.59.F04.1.454.CMB.2.raw
  modified_base (233)..(233): a, c, t, g, unknown or other
  misc_feature (233)..(233): n is a, c, g, or t
  modified_base (270)..(270): a, c, t, g, unknown or other
  misc_feature (270)..(270): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagcccgccctcagtgtctgccggccccaggacagaaggtcaccatctcctgctctggaagcagctaccaaanagttagggaataattttgtgtcctggtaccagcagcnccaggaacacgaccccaaactcctctattttgaactaaataactaagccgtaccctacgacgggtactttcccgtagtaccgtatttcctcgtcggtccttaccccgaagttcgtcggcctacgtaccacgcccgacccgtcggggacctacgtacccgacccgggaccttacccgaacggtacggttacgggggaaccggacgggtacccgtaagttttaacgttaccgttacggaaccgggaaacgtaacgttaggggaacgttaacggcggaacggtcccgttaggtaacgtacgttcggtagtaagttaaacggtcgggggtacgggaacgggaaccaagggcgtacggacccgtcgttaggtccgaacggacccgacggccgtccgccccgtcggtcctacgttcctccgttccccgtaaccccg

SEQ ID NO: 350349 - DNA, 649 bp, Homo sapiens
  misc_feature: GZ8MTXP01APXER.19.59.F04.1.454.CMB.2.raw
  modified_base (170)..(170): a, c, t, g, unknown or other
  misc_feature (170)..(170): n is a, c, g, or t
  modified_base (217)..(217): a, c, t, g, unknown or other
  misc_feature (217)..(217): n is a, c, g, or t
  modified_base (245)..(245): a, c, t, g, unknown or other
  misc_feature (245)..(245): n is a, c, g, or t
  modified_base (262)..(262): a, c, t, g, unknown or other
  misc_feature (262)..(262): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgcctnagtgtctgcggcccaggacagaaggtcaccatctcctgctctggaancagctaccaatagttgggaatattttgngtcctggtacagcagcnccaggacacgccccaactcctctattttagaactaaataataagcgacctacgacgggtattacctgaccgtattctctcggctcccaagtcgtggcacgtccacgcccacccgtcgggactacgtccgaccggactaccgagtaccgtgggggaccgaggccgtaattacgttacgtgacggaacagtagggatacgcgaacggtccgtaggtaacgttacgtgtagtaacgtaacggtcggtacggggaaggaacccgaaaggtccgtacggttacccggttaccgttaacgggttcccgaacggttaccccggacggttacccgtccccggtcccccgttaacggttcccgtaaccgttcccgttaaccgttccccgtaacccg

SEQ ID NO: 350350 - DNA, 517 bp, Homo sapiens
  misc_feature: GZ8MTXP01EIZHK.19.59.F04.1.454.CMB.2.raw
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (309)..(309): a, c, t, g, unknown or other
  misc_feature (309)..(309): n is a, c, g, or t
  modified_base (437)..(437): a, c, t, g, unknown or other
  misc_feature (437)..(437): n is a, c, g, or t
  modified_base (502)..(502): a, c, t, g, unknown or other
  misc_feature (502)..(502): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaancagctcaanattgggaanattttgngtctggtacagcagcnccaggacagccccaaactcctcattttgacaaataataagcgaccctanagggattccctgaccgattctactggcctcccaagtctggcacgtcagccaccctgggcatccacggctccagctggggacgagccgattatactgacggaacagtgggatagcgagcctagagtacngtagataaagtcggcggaggaccaagctagaccgtcttagtcacgccgaggctgccccgtgtccncttctcgttccctcc

SEQ ID NO: 350351 - DNA, 527 bp, Homo sapiens
  misc_feature: GZ8MTXP01DIIH4.19.59.F04.1.454.CMB.2.raw
  modified_base (219)..(219): a, c, t, g, unknown or other
  misc_feature (219)..(219): n is a, c, g, or t
  modified_base (247)..(247): a, c, t, g, unknown or other
  misc_feature (247)..(247): n is a, c, g, or t
  modified_base (461)..(461): a, c, t, g, unknown or other
  misc_feature (461)..(461): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaancagctccaaacattgggaataattttgngtcctggtaccagcagctcccaggaacagcccccaaactcctcattttgaacaataataagcgacctcagggattcctgaccgattctctgctcccaagtctggcacgtcagccaccctgggcatcaccggactccagactggggacgaggccgtaattattactgcggaacagtgggaatagcgaagcctagagtaactgtgataaagtcggnggaggaccaagctgaccgtcttaggtcacgccgagctcgcccctggtcacttctcgttcccgcccc

SEQ ID NO: 350352 - DNA, 693 bp, Homo sapiens
  misc_feature: GZ8MTXP01DXF8W.19.59.F04.1.454.CMB.2.raw
  modified_base (228)..(228): a, c, t, g, unknown or other
  misc_feature (228)..(228): n is a, c, g, or t
  modified_base (261)..(261): a, c, t, g, unknown or other
  misc_feature (261)..(261): n is a, c, g, or t
  modified_base (264)..(264): a, c, t, g, unknown or other
  misc_feature (264)..(264): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgcctcagtgtctgcggcccaggacagaagtcaccatctcctgctctggaagcagctaccaaanagttgggaatattttgcgtcctggtaccagcanccncccaggaaccacgaccccccaaactcctactattttacgaactaaataaactaacgccgtaccctacgaagggtactttccgtacgtaccgtatttcctcgtcggcctaccccgaagtctggacccaccgttaccaacgtccccgaaacccgtcggggaccctaacgttacccgaacccgggtacctacccgaacggtacggtacgggggaacgacgggaccgtaagtttaacgttacgtagaccgggaactagtagggaataggcaacgtcctagagtacctggtagtaataaacggtcgggacggacggaacccaaggtccgtaacggaccgtaccggttaacggaccgaacggacccgaacggccgtaacccggtcccccgtaacgggtccctaccgttccgttcccggtttcccccgtaaccccg

SEQ ID NO: 350353 - DNA, 603 bp, Homo sapiens
  misc_feature: GZ8MTXP01EEZCU.19.59.F04.1.454.CMB.2.raw
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (267)..(267): a, c, t, g, unknown or other
  misc_feature (267)..(267): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaaanagttagggaataattttgngtcctggtaccagcagcnccaggaacacgacccccaaactcctcatttttgaacaataaataacgccgaaccctcgaacgggtactttacccgtgaccgatttcctctcggctccccaagtcgtgccacgtcacgccacccgtgggcactccaccggactccgagacgtggggacgacggccatttaattacgtaggacggaacagtgggaataggcgaacgccgtagagtacgtgtgaagtaagtcgggacggagggacccaagcgtcggaccgtccgttaggtcgacgacccgacggccctaaccgtccccgtaacggtcctaccgttccgttcccgttccccgtaaccccg

SEQ ID NO: 350354 - DNA, 690 bp, Homo sapiens
  misc_feature: GZ8MTXP01D1ZH6.19.59.F04.1.454.CMB.2.raw
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagcccgccctcagtgtctgccggccccaggacagaagtcaccatctcctgctctggaancagctaccaaanagttgggaatattttgcgtcctggtaccagcagctcccaggaaccacgacccccaaactcctactattttgaactaataataagccgaccctcgagggtacttcctgaccgtattcctctggcctcccaagtcgtggccacgtacacgccacccgtgggccatccgaccggactcgagacgtgggacgaggccgtaattatacgtgacgaacagtggaatagcgtaacgccgtagacgttatgtagtaaagttaacggccggggtacgggaaccgggaacccgaaggtaacccgttaaccggaaccccggttaccgttaaacggggttaaccgaaccggttaacccccggaaacggggttccccttaaccccgggtacccccccccgttaaccgggtttccccgaaccccggtttcccgtttaacccccgggtttcccccccggttaacccccccccg

SEQ ID NO: 350355 - DNA, 557 bp, Homo sapiens
  misc_feature: GZ8MTXP01A4CTG.19.59.F04.1.454.CMB.2.raw
  modified_base (525)..(525): a, c, t, g, unknown or other
  misc_feature (525)..(525): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctgggtggagtcgtgggggaggcttggtacaggcctgggagggtccctgagactctcctgtgcagcctctggattcaccttcagtagttatagaaatggaatttggggcccgcgaggcctcgagggggaaggggctggagtgggttcataccagttagtagtagtggtaagtagcatatactacgcagactctggtgaagggccattccactatctccagacgacacgacgaccaaaggactacactgtaatcctgacaaatgaaaccagacctggaagacggccggaaggttaccgacgggtcttaaggtttacttacgnggtaggcgaaggaggaggtggaacgtaagggg

SEQ ID NO: 350356 - DNA, 532 bp, Homo sapiens
  misc_feature: GZ8MTXP01AYWZ0.19.59.F04.1.454.CMB.2.raw
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (451)..(451): a, c, t, g, unknown or other
  misc_feature (451)..(451): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctgggtggagtcgtgggggagcttggtacagcctgggagggtccctgagactctcctgtgcagcctctggattcaccttcagtagttatgaaatgaagttgggtccgccaggctccgaggggagggctggagtggttcatacattagtagtagtggtaagagcatatactacgnagactntgtagaacgggcattccactatctcagagacagcacaagactcactgtatctgacaaagtcgaaacngcctaggaacgacggccggaaggacgaacgggtcttaagttttcttacgtggtgcggtaagaggaggtggaacgtaagggg

SEQ ID NO: 350357 - DNA, 579 bp, Homo sapiens
  misc_feature: GZ8MTXP01AN66U.19.59.F04.1.454.CMB.2.raw
  modified_base (247)..(247): a, c, t, g, unknown or other
  misc_feature (247)..(247): n is a, c, g, or t
  modified_base (363)..(363): a, c, t, g, unknown or other
  misc_feature (363)..(363): n is a, c, g, or t
tcagtactctcgtgcacgaccggtgctcgatttagtacacacacttagggattgggggcagaaggcaggactcgggacaatcttcatcatgacctgctcccctctcctcctcaccattctcattcactgcacagggtcctgggcccagtctgtgttgacgcagccgccctcagtgtctgccggccccaggacagaaggtcaccatctcctgctctggaagcagctccaacagttgggaatattttgngtcctggtaccagcagctcccaggaacacgacccccaaactcctctattttgacaataataagcgaccctgaggtattcctgaccgattctctcggcctccaagtctgcaacgtcncgccacccgtgggcatcaccggactccagacgtggggacgaggcccgtaattacttacgtggacggaacagtggggatagggcgagtcctgagtacgtggtagaataaacggtcgggacgggaacgggacaaggcgttaggacccgttcgtacgggtcacggcccgaacggccctcggcccccgttcgggtccaccgttccgttccgttaaccccc

SEQ ID NO: 350358 - DNA, 574 bp, Homo sapiens
  misc_feature: GZ8MTXP01CYCIJ.19.59.F04.1.454.CMB.2.raw
  modified_base (268)..(268): a, c, t, g, unknown or other
  misc_feature (268)..(268): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggcccaggacagaaggtcaccatctcctgctctggaagcagcctaccaaacagttgggaataatttttgtgtcctggtaccagcagcncccaggaacacgcccccaaactcctctatttttgacaaataataacgcgacccctgagggactttcctgaccgattctctggctccccaagtctggcacgtcacgcccacccgtgggcactccgacccggactcccgagacgtggggacgaggaccgattattactggaccgaacagtgggaatagcgacgcctaggagtactgtgaataagtcgggacggacggaaccagcgtcgaccgttccgaggtcaacgcccgaaggcctccgcccccgtcggtccacttccgtccgttccccgtcccccg

SEQ ID NO: 350359 - DNA, 594 bp, Homo sapiens
  misc_feature: GZ8MTXP01CHUXT.19.59.F04.1.454.CMB.2.raw
  modified_base (170)..(170): a, c, t, g, unknown or other
  misc_feature (170)..(170): n is a, c, g, or t
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
  modified_base (263)..(263): a, c, t, g, unknown or other
  misc_feature (263)..(263): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctggcccagtctgtgttgacgcagccgccctnagtgtctgcggcccaggacagaagtcaccatctcctgctctggaancagcctaccaanagttgggaatattttgngtcctggtaccagcagcncccaggaaccacgacccccaaactcctctatttttgaacaaataaataagccgacccctcagggtacttcccgtgaccgattctctggctccccaagtctggtactcaacgcccaaccctgggccagtccacccggactccagacgtgggacgaggccgattatacgtgacgaacagtagggatagcaggcctagacgtacgtgtagagtagtacgggcggaacggaccaagcgtaacggaaccgttccgtaggttccgaacggcccgaaaggcccttccggtccccccgtacggtccaccgttccgttccgttcccccgcccgttccccg

SEQ ID NO: 350360 - DNA, 527 bp, Homo sapiens
  misc_feature: GZ8MTXP01BY42N.19.59.F04.1.454.CMB.2.raw
  modified_base (257)..(257): a, c, t, g, unknown or other
  misc_feature (257)..(257): n is a, c, g, or t
  modified_base (283)..(283): a, c, t, g, unknown or other
  misc_feature (283)..(283): n is a, c, g, or t
  modified_base (309)..(309): a, c, t, g, unknown or other
  misc_feature (309)..(309): n is a, c, g, or t
  modified_base (460)..(460): a, c, t, g, unknown or other
  misc_feature (460)..(460): n is a, c, g, or t
  modified_base (470)..(470): a, c, t, g, unknown or other
  misc_feature (470)..(470): n is a, c, g, or t
  modified_base (497)..(497): a, c, t, g, unknown or other
  misc_feature (497)..(497): n is a, c, g, or t
  modified_base (515)..(515): a, c, t, g, unknown or other
  misc_feature (515)..(515): n is a, c, g, or t
  modified_base (520)..(520): a, c, t, g, unknown or other
  misc_feature (520)..(520): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctatttagaaggtgtccagtgtgaggtgcagctggtggagtcgtgggggaggcttggtacagcctgggagggtccctgagactcncctgtgcagcctctggattcaccttnagtagttatgaaatgaattgggtccncgaggctccgaggggaggctggagtggttcataccattagtagtagtggtaatagcatatactacgcagactctgtgaagggccattccactatcctacagagacagaccgaccaaaggaactcaactgtaatctagacaaaatgaaaccngcctagaagngccggaaggacacgggcttaaggtttnttactggtgaagaggagngtggngtaaggg

SEQ ID NO: 350361 - DNA, 799 bp, Homo sapiens
  misc_feature: GZ8MTXP01D2XK5.19.59.F04.1.454.CMB.2.raw
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaancagctaccaanagttgggaatattttgcgtcctggtaccagcagctcccaggaacacgacccccaaactccctactatttttacgaactaaataaactaacgccgtaacccctacgacgggtaactttcccgtagaccgtatttcctacgtggcctaccccgaagtcgtggcctacggtccaacgcccacccgtgggcctacgtccgaacccggggactacccgacgtaccggtacgggggaaccgacgggtacccgtaaagttttaacgttaaccgttacgggaccgggaaaaccgtaggtacgggggtaaattacggaccggtaacggtacccgttaaggtaacggttaaccgttaggttaacgtaaagtttaaaaccggtccgggggtaacgggtaaacgggggtaaacccgaaaacggtccggttaaccggttaaaccccgggttcccgttaaacggggttacccgtaacccgggaccccggttaaacgggttcccccgttaacccgggtaccccccccgtttggggttaccccaacccgtttacccgtttcccggttttaacccccgtaaccccg

SEQ ID NO: 350362 - DNA, 555 bp, Homo sapiens
  misc_feature: GZ8MTXP01A47IG.19.59.F04.1.454.CMB.2.raw
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
  modified_base (260)..(260): a, c, t, g, unknown or other
  misc_feature (260)..(260): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgcctcagtgtctgcggccccaggacagaagtcaccatctcctgctctggaancagctcaanattgggaatattttgngtcctggtaccagcagcnccaggaacacgccccaaatcctctattttgaacaaataataacgcaccctacgagggtacttccctagaccgtattcctctggcctacccaagtctggccacgtcacgcccaccgtgggcactccgaccggactccagacgtacggggacgaggccgattacgtacgtagacggaacagtggatacgcgagtccgtagagtactgtagataacgtcggacggaggaccagctgaccgtcgaggtcacgcccgaggcctcgcccctcggtccacgttccgtccgttccccgtcccc

SEQ ID NO: 350363 - DNA, 607 bp, Homo sapiens
  misc_feature: GZ8MTXP01C9XKG.19.59.F04.1.454.CMB.2.raw
  modified_base (228)..(228): a, c, t, g, unknown or other
  misc_feature (228)..(228): n is a, c, g, or t
  modified_base (246)..(246): a, c, t, g, unknown or other
  misc_feature (246)..(246): n is a, c, g, or t
  modified_base (263)..(263): a, c, t, g, unknown or other
  misc_feature (263)..(263): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaagtcacatctcctgctctggaagcagctaccaanagttagggaatattttgngtctggtaccagcagcnccgaaggaaccacgacccccaaactcctactattttacgaactaaataaataacgccgaccctacgagggtacttacctgaccgtattcctcgtcggtcctacccgaagtctggccacgtcacgcccgacccgtgggacacgccgtacccggactcccgagacgtaggggaacgacggccgtaattacgttacgtcggacgtaaacaggtggaacgtagacgagtcctagacgtagtgtagagtaagcggtaggaacgacgagcgtcgacccgtacgttaggacaccggttaccgacggttcctcccgcccgtcgacctcgttccgtcccgttccccgtccccg

SEQ ID NO: 350364 - DNA, 859 bp, Homo sapiens
  misc_feature: GZ8MTXP01E5SBI.19.59.F04.1.454.CMB.2.raw
  modified_base (322)..(322): a, c, t, g, unknown or other
  misc_feature (322)..(322): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagcctgggagggtccctgagactctcctgtgcagcctctggattcaccttcagtagttatagaaatggtaaagtttcgggggtaccccnccgaagggccttaccccggaaggggggtaaacggggggtccgtttagggggtaaggtttcggggggtttttaccaagtttaaccccgtaagtttttaaagggttaaggtttaaagggttaggggtttaaaagggttaaggtcctaaatttaaactaaacccgttaccggacgtaaacgggtaaccctttcggttacgggttagggaaaacggggggtaccccgtaactttacccgaaacccctaacttcccgttaccccaaagggaacggaacccaacggaccccggtaaccccaaaacggggtaaacccttcccgtaaaccctttagggttaaacgttcccgttaacggaacccaaaaaagttccggaaaaacctaccgggaccccgttaaggggaaacgggaaacgggttaccccggggaaacggggaacccgaaaccgggggtcccttaaagggttttttaattaacccggtttggtacgggaaccgggtaagggaagggttaaacgggttcggggttaaccgtaaaagggggg

SEQ ID NO: 350365 - DNA, 536 bp, Homo sapiens
  misc_feature: GZ8MTXP01ACV9A.19.59.F04.1.454.CMB.2.raw
  modified_base (230)..(230): a, c, t, g, unknown or other
  misc_feature (230)..(230): n is a, c, g, or t
  modified_base (247)..(247): a, c, t, g, unknown or other
  misc_feature (247)..(247): n is a, c, g, or t
  modified_base (265)..(265): a, c, t, g, unknown or other
  misc_feature (265)..(265): n is a, c, g, or t
  modified_base (422)..(422): a, c, t, g, unknown or other
  misc_feature (422)..(422): n is a, c, g, or t
  modified_base (424)..(424): a, c, t, g, unknown or other
  misc_feature (424)..(424): n is a, c, g, or t
  modified_base (457)..(457): a, c, t, g, unknown or other
  misc_feature (457)..(457): n is a, c, g, or t
  modified_base (471)..(471): a, c, t, g, unknown or other
  misc_feature (471)..(471): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagcccgccctcagtgtctgcggccccaggacagaaggtcaccatctcctgctctggaagcagctccaanattgggaataattttgngtcctggtaccagcagcncccaggacacgcccccaaactcctcatttttgacaataataagcgaccctcagggattccctgaccgtattctctggctccccaagtctggcacgtcagccacctgggcatcaccggactccagacgtggggacgaggccagttatactgcgaacgngnggatagcgagcctgagtactgtgataagtcggngggacggacaagcngttacccgtccgttagggtcaagcgacgaaggcctcgccccctcggtccactcgttcgtcccccg

SEQ ID NO: 350366 - DNA, 571 bp, Homo sapiens
  misc_feature: GZ8MTXP01EUZS4.19.59.F04.1.454.CMB.2.raw
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (290)..(290): a, c, t, g, unknown or other
  misc_feature (290)..(290): n is a, c, g, or t
tcagtactctcgtgcacgaccggtgctcgatttagtacacacacttagggattgggggccctagccctggattccaaggcatttccacttggtgatcagcactgaacacagaggactcaccatggagttggggctgtgctgggttttccttgttgcttattttagaaggtgtctagtgtgaggtgcagctggtggagtcgtggggggagcttggtacagcctggagggtccctgagactctcctgtgcagcctntggattcaccttnagtattangaaatgaattggccncaggctcgagggagggctggagtggttacatacagtttagtagtagtggtagtagacatatactacgcagaactgtggtagaagggccctattccacatccaccagacgacagccgaccaaagactcactagtactctagacaaagtcgaaacacgacctaggaacgacggccgaaaggacctacgggtacttaagtttataacgtggttggagaaggaggtaggttggacttaagggtgggacggggtcgaataggttggtaagggttggggttaacggg

SEQ ID NO: 350367 - DNA, 717 bp, Homo sapiens
  misc_feature: GZ8MTXP01DX8CQ.19.59.F04.1.454.CMB.2.raw
  modified_base (220)..(220): a, c, t, g, unknown or other
  misc_feature (220)..(220): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggccccaggacagaaggtcaccatctcctgctctggaancagctcaacagttgggaatatttgtgtctggtaccagcagctccaaggaacacgacccccaaactcctactattttgaactaaataataacgccgaccctacgagggtacttcccgtacgaccgtattcctctcggcctacccgaagtcgtggccacgtacacgccctacccgtgggaccacgtacccgacccgggtacctacccgtaacggaaccggttacgggggaaccggaacgggtacccgtaagttttaaccgttacgtacgggaaccggtaaacgacgtaggggtaactacggacgacggtaccgtaggtacgttacgtgtagtaacgttaaacggtccggggtaccgggaacgggtacccgaaggtcccggttacggttaacccggtccggttaaccggtcgaaacccggaccccgaacgggttccctaacccggtcccccgttaaccgggtccctaccgttcccgttccccgtttcccccggtcccccg

SEQ ID NO: 350368 - DNA, 601 bp, Homo sapiens
  misc_feature: GZ8MTXP01CU81G.19.59.F04.1.454.CMB.2.raw
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (239)..(239): a, c, t, g, unknown or other
  misc_feature (239)..(239): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcgcccaggacagagtcacatctcctgctctggaancagctcaanagttgggaatatttgngtcctggtaccagcagctccagaccacgaccccaaactcctctattttgaactaataactaacgccgaccctacacgggtacttcccgtagaccgtattctctggctaccccaagtctggcacggtacacgccacccgtgggcactcgaccgactaccgacgacgtacggggacgacggaccgtattaacgttacgtggacggaacagtagggatacgcgacggtccgtaggacgtacgtgtagtagtaacggtcggtcgggaggaccgaggtcctacggaccgtccgaggtaccgacggacccgaacggttcccgtccgacccccgttgtcccgtacttccgttccgttccccgtcccccg

SEQ ID NO: 350369 - DNA, 600 bp, Homo sapiens
  misc_feature: GZ8MTXP01BE7US.19.59.F04.1.454.CMB.2.raw
  modified_base (318)..(318): a, c, t, g, unknown or other
  misc_feature (318)..(318): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgcttgggttttccttgttgctattttagaaggtgtccagtgtgaggtgcagcgtggtggagtcgtgggggagtcttggtacaggcctgggacgggtccctgagactctcctgtgcagcctgtggacttccacttcagtagttatagaaatgtaagtcgggtccncgaggctcggaaggggagggcgtggtagttggttacatactagttagtagtagtgtaaagtagctatatactacgcagtactcgtagtaggaacggtccgtattacccacgtaacttccaccaaggacgacacggaccaaccgaaaggtaacctcgaacgttagtacttaccgagaactaaagtcgtaaaccgcgtaccgaggaaccggacgacccgggaagaccgacgggtacttaagtttcgttacgtggcgaaggtagaggttaggtcgaagtaagggg

SEQ ID NO: 350370 - DNA, 531 bp, Homo sapiens
  misc_feature: GZ8MTXP01ALJNS.19.59.F04.1.454.CMB.2.raw
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
  modified_base (415)..(415): a, c, t, g, unknown or other
  misc_feature (415)..(415): n is a, c, g, or t
  modified_base (441)..(441): a, c, t, g, unknown or other
  misc_feature (441)..(441): n is a, c, g, or t
  modified_base (510)..(510): a, c, t, g, unknown or other
  misc_feature (510)..(510): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgcctcagtgtctgcggcccaggacagaaggtcaccatctcctgctctggaancagctcaanttgggaanatttgngtctggtaccagcagcnccaggacacgccccaaactcctctattttgacaataataagcgacctcagggtacttcctgacgtattctctggctcccaagtctcggcacgtcacgcccaccgtgggcatcaccggactcagctggggactaggccgtattactacgtgacggaacntgggatacgcgagctgagtacgtgtnagtaagtcggacggaggacaagcgtgaccgtcgagggtcagccccgaagcctaacgccccgtcggaccnccgttctcgttccccgtcccc

SEQ ID NO: 350371 - DNA, 527 bp, Homo sapiens
  misc_feature: GZ8MTXP01DQARL.19.59.F04.1.454.CMB.2.raw
  modified_base (276)..(276): a, c, t, g, unknown or other
  misc_feature (276)..(276): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
  modified_base (397)..(397): a, c, t, g, unknown or other
  misc_feature (397)..(397): n is a, c, g, or t
  modified_base (406)..(406): a, c, t, g, unknown or other
  misc_feature (406)..(406): n is a, c, g, or t
  modified_base (446)..(446): a, c, t, g, unknown or other
  misc_feature (446)..(446): n is a, c, g, or t
  modified_base (479)..(479): a, c, t, g, unknown or other
  misc_feature (479)..(479): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctatttagagtgtcagtgtgaggtgcagctggtggagtcgtgggggagcttggtacagcctggagggtccctgagactctctgtgcagcctctggattcacttnagtagtatgaaatgattcgggccgcgaggctcgagggagggctggtagttggttcatacagttagtagtagtggtaagtancatanactcgnagactctgagacgggcattcacctatccncgagagacngacgaccaaagggactcactgtactctgacaaatgaaacngcctggaacgcgaccgggaggacgaaccgggtnttaaggtttttcacgtggtacgaacgaggaggacgtggaacgtaaggg

SEQ ID NO: 350372 - DNA, 657 bp, Homo sapiens
  misc_feature: GZ8MTXP01CKC27.19.59.F04.1.454.CMB.2.raw
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
  modified_base (307)..(307): a, c, t, g, unknown or other
  misc_feature (307)..(307): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgcctcagtgtctgcgcccaggacagaagtcaccatctcctgctctggaancagctccaanagttgggaatattttgtntcctggtaccagcagcnccaggaacacgccccaatcctctattttgacaataatagcgaccctnaggtacttcctgaccgtacttctcgtcggtcctaccccgtaagtcgtggcctaccgtaccacgtccctacccgtggggacctacgtaccgacccggtacgtcccaacggacgtcgggggaaccgacgggtaccgtaatttaacgttaccgtggaccggtaaacgtagtaggggtactaggacgtaggtacccgttaggaacgttacgtggttacgaagttaaacggtccgggacgggtaacgggaaccaaggtccgtacggttacccgtacgttacggtaccgacgacccgttacggcgtaacccggccccgtcggtccgtaccgttccgttcccgttccccggtccccg

SEQ ID NO: 350373 - DNA, 615 bp, Homo sapiens
  misc_feature: GZ8MTXP01BQSUB.19.59.F04.1.454.CMB.2.raw
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (377)..(377): a, c, t, g, unknown or other
  misc_feature (377)..(377): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggccccaggacagaagtcaccatctcctgctctggaancagctaccaanagttgggaataattttgcgtcctggtaccagcagcaccaggaacacgaccccaaactcctctattttgaactaaataataacgccaccctagacgggtattccgtgaccgtattctctcgcctcccaagtctggtactcaacgcccnccgtgggccactccaccggacctcgacgacgtgggacgacggcgtaattagttacgtcgtacgaacgagtagggatagccacgggcgtagacgtacgtgtacgtagtaagtacgggacggtaacgggactaacggcgtaacggcccgttacgtacggttaccgaccgtacccgaacgggttccacccggtccccctcgggtaacctccgtcccgttcccggttccccgccccttcccg

SEQ ID NO: 350374 - DNA, 734 bp, Homo sapiens
  misc_feature: GZ8MTXP01BHKNY.19.59.F04.1.454.CMB.2.raw
  modified_base (217)..(217): a, c, t, g, unknown or other
  misc_feature (217)..(217): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagcccgcctcagtgtctgccggcccaggacagaagtcaccatctctgctctggaancagcctaccaaactagttagggaaagttattttgcgttccgtaggtaccagcagcctacccaggaaccacgacccccaaactcctactattttacgaaactaaataaacgtaacgaccgtaacccctacgtacgggtactttacccgtacgacccgttatttccgtacgttcggtaccttaccccgaaacgtttcgacggacctacgtaccacgtccccgaacccggtgggaccctacgtcccgaacccggtactacccgaggtaccgtacggggaacgacggaccgttaagttacgttacgtgaaccgggaactagtacgggaatacggacgacgccgttaggaactcgtgagtagttaaacgggccgggacggggaacggacccgaagggtaacccgtacggacccgtccggttaacgggaccctaaccgggaccccgacggggttaccctccccgggtacccccttcgggtacccctaccggttccccgttcccggttaaccccctaacccccg

SEQ ID NO: 350375 - DNA, 580 bp, Homo sapiens
  misc_feature: GZ8MTXP01BWCAE.19.59.F04.1.454.CMB.2.raw
  modified_base (172)..(172): a, c, t, g, unknown or other
  misc_feature (172)..(172): n is a, c, g, or t
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (261)..(261): a, c, t, g, unknown or other
  misc_feature (261)..(261): n is a, c, g, or t
  modified_base (308)..(308): a, c, t, g, unknown or other
  misc_feature (308)..(308): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagcccgccctnagtgtctgcggcccaggacagaaggtcaccatctcctgctctggaancagctcaaanttgggaatattttgngtcctggtacagcagcncccagacacgccccaaatcctcattttgacaataataagcgaccctnagggattcctgaccgtattctctggctccccaagtctggcacgtcagccacctgggcactccgaccggactccgagacgtcggggacgagggccgtatttaactacgtaggccggaaacagtgggattagccgaagccgtagagtaccgtgtagaataacgtcggacggagggaccaaaggcttacgaccgtacgttaggtccaacgttcccgaaaggcccgttcgcccccccgtgggttcccgaccttccgttccggttccccgtcccccg

SEQ ID NO: 350376 - DNA, 658 bp, Homo sapiens
  misc_feature: GZ8MTXP01EQL6Y.19.59.F04.1.454.CMB.2.raw
  modified_base (219)..(219): a, c, t, g, unknown or other
  misc_feature (219)..(219): n is a, c, g, or t
  modified_base (268)..(268): a, c, t, g, unknown or other
  misc_feature (268)..(268): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaancagctaccaaatagttagggaataattttgtgtcctggtaccagcagcnccaggaacacgaccccaactcctctatttgaactaaataataacgccgaccctacgtagggtacttcccgtagaccgtattctcgtgcctacccgaagtctggccacgtacacgcccaccgtgggacacgtcccgaccgggactaccgacgacggtacgggggaacgacgggtacccgtaagtttaacgttacgtacgggaccggtaaacgtacggtaggggtaattacgggacgtaacggtccgtagtaacgtaacgtgtagtaagtaacggtcggggacgggtaacgggaccaaggccgtacggacccgtccgttaacggtccacggacccgaaggcccgtcccgccccgtaacggtcctacgttccgttcccgttcccctaaccccg

SEQ ID NO: 350377 - DNA, 549 bp, Homo sapiens
  misc_feature: GZ8MTXP01ENLC0.19.59.F04.1.454.CMB.2.raw
  modified_base (451)..(451): a, c, t, g, unknown or other
  misc_feature (451)..(451): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaggtgtccagtgtgaggtgcagctgggtggagtcgtgggggaggtcttggtacagcctgggagggtccctgagactctcctgtgcagcctctggattcaccttcagtagttatgaaatgaattgggtccgcaggctccgaggggaagggctggagtggttcatacattagtagtgtggtaagtagcaatataactacgactaggacttctagtaggaacgggccgtattccactaactctaccgaagacgacagccgaccaaaggactanactgtaatctagacaaaatcgaaacagccgtggaacgacgaccggaggacgacgggtacttaggtttattacgtgtgcgagtagagttggcgtaaggg

SEQ ID NO: 350378 - DNA, 574 bp, Homo sapiens
  misc_feature: GZ8MTXP01EJP40.19.59.F04.1.454.CMB.2.raw
  modified_base (273)..(273): a, c, t, g, unknown or other
  misc_feature (273)..(273): n is a, c, g, or t
  modified_base (353)..(353): a, c, t, g, unknown or other
  misc_feature (353)..(353): n is a, c, g, or t
  modified_base (374)..(374): a, c, t, g, unknown or other
  misc_feature (374)..(374): n is a, c, g, or t
  modified_base (528)..(528): a, c, t, g, unknown or other
  misc_feature (528)..(528): n is a, c, g, or t
tcagtactctcgtgcacgaccggtgctcgatttagtacacacacttagggattgggggccctagccctggattccaaggcatttccacttggtgatcagcactgaacacagaggactcaccatggagtcggggctgtgctgggtttccttgttgctattttagaggtgtccagtgtgaggtgcagctggtggagtcgtgggggagcttggtacagccgtggagggtccctgagactctcctgtgcagcctctggattcaccttcagtagttangaaatgaagttgggtcccgcgaggcctcgaggggaggggctgggtagtggttacatactattagtagtagtggtagtagntatactactacgcagtaactntggtagaacgggctattcacctatcctaccagagacagccgacaaagactcaactgtaatctagacaaagtcgaaacacgcgtaggaagacggccgaaagggtccacgggtataagttttataacgttgaggacgttagaaggtaggttcgganaaagggtgggacgggtcggaatggttaggtgggttggggttaacgg

SEQ ID NO: 350379 - DNA, 869 bp, Homo sapiens
  misc_feature: GZ8MTXP01DSO41.19.59.F04.1.454.CMB.2.raw
  modified_base (219)..(219): a, c, t, g, unknown or other
  misc_feature (219)..(219): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggcccaggacagaagtcaccatctcctgctctaggaancagcctaccaatagttagggaattattttgtcgtcctggtaccagcagctcccaggaacacgacccccaaactcctctattttgaaactaataactaagccgtaccctacgagggtactttcccgtagaccgtattccttacgtcggtcctaccccgaacggttccgtggacctaaccgtcccacggccccaaacccggttcggggacccacgttaccccgaacccggggtaacccttacccgaacggaaccgggttcggggggaaaccggtacgggtaccccggttaaagttttaaacgtttaaccggttacggaaccggggaaaacctaagggtacgggggtaaattacggaccggaacggtcccgttaggtaacggtttaccgttggtaacgttaacgtttaaaacgggtccgggggtaaccggggtaaacgggggtaacccgaaacgggtaaccccggttaacccgggttaaacccgggttaccccgggttttaaagggtaaccccggtaaccgggaacccccggttaaaacggggttcccccggtaacccccgggttaccccccccgtttaacccgggggttcccctaaccccgggtttcccgttttccccccgggggtttaacccccccgtttccccccccccg

SEQ ID NO: 350380 - DNA, 610 bp, Homo sapiens
  misc_feature: GZ8MTXP01B4W1O.19.59.F04.1.454.CMB.2.raw
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
  modified_base (367)..(367): a, c, t, g, unknown or other
  misc_feature (367)..(367): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
tcagtactctcgtgcacgaccggtgctcgatttagtacacacacttagggattgggggccctagccctggattccaaggcatttccacttggtgatcagcactgaacacagaggactcaccatggagttggggctgtgctgggttttccttgttgcttattttagaaggtgtccagtgtgaggtgcagctgggtggagtcgtgggggagcttggtacagcctgggagggtccctgagactctcctgtgcagcctntggattcaccttnagtagttangaaatgaattgggccncaggctccgagggaggggctggagttggttcatacagtttagtagtagtggtagtagcatatacacgcagactntgtgaagggccatcacatcncaganacagccgacaaagactcactgtactcgagtaccaaagtcggaaacacgtccgtaggaacggacggacccggaaagggacccgtacggggtaccttaaggtttttacttaacggttggttgggaccggaaggtagggtaggttacggggttcgttaaagggttgggggacgggggttcggaacgttaggtttaggggtaagggtttgggggttaacggg

SEQ ID NO: 350381 - DNA, 661 bp, Homo sapiens
  misc_feature: GZ8MTXP01E0GL9.19.59.F04.1.454.CMB.2.raw
  modified_base (318)..(318): a, c, t, g, unknown or other
  misc_feature (318)..(318): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctgggtggagtcgtgggggaggtcttggtacaggccgtgggacgggtcccctgagactctcctgtgcagcctcgtggattcaccttcagttagttatagaaatgaattgggccncaggctcgagggaggctggagtgggttcagtactagttagtagtagtggtaagtagctatatactacgcagactcgtgtaggaacggggtccgtaattccgaacctactaccgtcccgaaggacgacgacggaccgaacccgaaaggggaaaccttcgtaaccgttagttaactccgttaggaacctaaaagtcgaaaccgacggcccgttagggaacggaacggggaccccgggaaaggggaacccgtaaccgggggtactttaaagggtttttacgttaaccggttgggtacgggaacgggtaagggaagggttacggggttgggaaccggttaaaggggg

SEQ ID NO: 350382 - DNA, 797 bp, Homo sapiens
  misc_feature: GZ8MTXP01DST4Z.19.59.F04.1.454.CMB.2.raw
  modified_base (219)..(219): a, c, t, g, unknown or other
  misc_feature (219)..(219): n is a, c, g, or t
  modified_base (269)..(269): a, c, t, g, unknown or other
  misc_feature (269)..(269): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaancagctaccaaactagttagggaataattttgtgtcctggtaccagcagcnccagacacgccccaaactcctactattttagaactaaataaataacgccgaaccccttagaacgggtactttcccgtacgtaccgtatttcctcgtcggaccttaccccgtaaacggttcgtcgggacctaccggtaccaacggccccacccgtcgggggaccaacgtacccgaaccccggggtacctacccgaacggtaaccgggttcgggggaaaccggaacgggtacccggtaaattttaaacgttaaccggttacgggacccgggaaactaggttagggggaacttaacggacgaacggtccgtaaggtaacgttaccgtaggtacgtaaggttaaacggtcggggtaacggggaaacgggacccgaaaggtcccgttaacgggttaccccggttaccgttaaacggggtacccaacgggttacccccgaaacggggttccccgttaacccggtcccccccggtttaacgggtcccctaccctttcccggtttaaccccggttaaccccccgttaacccccccg

SEQ ID NO: 350383 - DNA, 614 bp, Homo sapiens
  misc_feature: GZ8MTXP01BT8DJ.19.59.F04.1.454.CMB.2.raw
  modified_base (432)..(432): a, c, t, g, unknown or other
  misc_feature (432)..(432): n is a, c, g, or t
  modified_base (580)..(580): a, c, t, g, unknown or other
  misc_feature (580)..(580): n is a, c, g, or t
  modified_base (605)..(605): a, c, t, g, unknown or other
  misc_feature (605)..(605): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgcttgggttttccttgttgtctattttagaaggtgtccagtgtgaggtgcagcgtggtggagtcgtgggggagcttggacaggccgtgggagggtccctgagactctccgtgtgcagcctctggacttccaccttcgagttagttatagaaatgtaagttcggggtcccacgaggccgtaccggaagggggacgggggtcgttgggtacggttgggtttaccagttaacgtagtttaaggtagttaggtaggtaaagtagcgtataacgtactaccgnacgtactcgtagtaggacggccgtactcactatcctacgagagacacgacaccgaagaactcaacgtatatccgtagaacaaactgtaacagtcccgtggaacgacggccggaaggaccgtacggtaacgttagtttacttacgtggnggtaacggaagagttaggtaacggngtaaagggg

SEQ ID NO: 350384 - DNA, 710 bp, Homo sapiens
  misc_feature: GZ8MTXP01EQ6VG.19.59.F04.1.454.CMB.2.raw
  modified_base (323)..(323): a, c, t, g, unknown or other
  misc_feature (323)..(323): n is a, c, g, or t
tcagtactctcgtgcacgaccggtgctcgatttagtacacacacttagggattgggggcagctctcagagaggtgccctagccctggattccaaggcattttccacttggtgatcagcactgaacacagaggactcaccatggagttggggctgtgcttgggttttccttgttgcttattttagaaggtgtccagtgtgaggtgcagcgtggtgggagtcgtgggggaggtcttggtacaggcctgggagggtccctgagctctctgtgcagtcctctggacttcaccttcagttagttatagaaatgaagtttcgggtcccnccgaggcctaccggaagggggaagggcgtagggtaggttgggttacagttaccagtttagagttaggtggtaaagtagctaagttaactaacgtacgacgtaagacttctagggtagggaaacggggtcctaactttccgaacccgtaattccctaccgaaggacgtaccgaaggtacccgaacccgtaaagggaacccttcaaacgtttgtaacttccgtagaacctaaaaagtccggaaaaccctacggtaccgtaaggggaacgaaccgggttacccgggaaacggttacccgtaaccgggtaacttttaacggtttttacgttaccggtgggacggaacggggaaggtagggttaacggggttaacggttaacggtaaagggg

SEQ ID NO: 350385 - DNA, 611 bp, Homo sapiens
  misc_feature: GZ8MTXP01DSVBH.19.59.F04.1.454.CMB.2.raw
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (309)..(309): a, c, t, g, unknown or other
  misc_feature (309)..(309): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttgggctgtgctgggttttccttgttgctattttagaggtgtccagtgtgaggtgcagctggtggagtcgtgggggagtcttggtacagccgtgggacgggtccctgagactctcctgtgcagcctctggattcacttnagttagttangaaatgaattgggccncgaggctcggagggaggctggagttggttcatacattagtagtagtggtaagtagcatatactacgcagctctgtgaacggtccattccaaccatcctacgaggacgaacacgaccgacccgaaaggtaaacccttctaaaccgttaggttaactaccgttacggaaacctaaaaagttcggaaaacctaacggcccgtaagggaaacggtacggacccggaaagggttacccgtaacggtacttaaaggttttcttaacgtgggttacgaacggaggtagttagggtggaacgttaagggg

SEQ ID NO: 350386 - DNA, 682 bp, Homo sapiens
  misc_feature: GZ8MTXP01EVW75.19.59.F04.1.454.CMB.2.raw
  modified_base (594)..(594): a, c, t, g, unknown or other
  misc_feature (594)..(594): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgcttgggttttccttgttgcttattttagaaggtgtccagtgtgaggtgcagctgggtggagtcgtggggggagtcttggtacagccgtgggacgggtccctggacgacctctcctggtgcagtcctgtggacttccacctttcgaagttagttatagaaattggtaaacgtttcgggggtcccaccggaaggtcccgttacccggaaaggggggtaacgggggtccttgggggtaaggtttggggtttaaccaagtttaacccgtaagttttaggtaaggttaggttagggttaaaacgtagcttaaagttaacttaacccgtacgctaaggactttcgtaggtaggaacgggtcctaattccaaccgtaatcctaccgaagacgacgacgacgacccaaaggaactacactgtactcgtacgaactaaagtcgaaacncgtaccgtaggaacgacggaccggaacgaccgacggtacttaagtttcttacgtggtcgaacggaaggaggaggtggaacgtaagggg

SEQ ID NO: 350387 - DNA, 819 bp, Homo sapiens
  misc_feature: GZ8MTXP01COAAL.19.59.F04.1.454.CMB.2.raw
  modified_base (253)..(253): a, c, t, g, unknown or other
  misc_feature (253)..(253): n is a, c, g, or t
  modified_base (271)..(271): a, c, t, g, unknown or other
  misc_feature (271)..(271): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggccccaggacagaaggtcaccatctcctgcctctggaagcagcctaccaaacagttgggaataattttggngtcctggtaccagcagcnccaggacacgaccccaactcctctattttgacaaataataacgcgaccctgaggtacttccgtagaccgtattcctcgtcggtcctaccccgaacgtcgtcggacctaaccgtacccaacggtcccctaccccggtcggggaccctaacgtaccccgaaccccggggtacctacccgacgggtaaccgtcgggggaaccggacgggtacccgtaagtttaacgttaaccgtacggaaccggaaaccgtaacggtacggggtaagttaacggaccggtaacggtacccgttaggtaacgttaaccgttaggttaacggtaagttaaaaccgggttccgggggtaaccgggggtaaacggggtaaacccggaaacgggtaacccggttaccgggttaaaccccgggtttacccggttaaacgggttaacccgaacccgggttaacccccggaaacggggttaccccgttaaccccggtccccccccggttaaccgggttaccccgtacccgttccccgttccccgggtttcccccccggtaacccccccg

SEQ ID NO: 350388 - DNA, 690 bp, Homo sapiens
  misc_feature: GZ8MTXP01ELIHI.19.59.F04.1.454.CMB.2.raw
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggccccaggacagaaggtcaccatctcctgctctggaancagctaccaanagttagggaatattttgngtcctggtaccngcagcaccaggaacacgaccccaactcctactattttagaaactaaataactaacgccgaccctacgacgggtacttcccgtacgtaccgtattcctctacggtcctaccctaaggtctacggccaccgtaccacgcccgtacccgtcgggacctacgtacccgacccgggtacctacccgaacggtaccgtacgggggaacgacgggtacccgtaagtttaacgttaacgtcggaaccgggtaaacagtagggtaatacggacgtaacggtccgtagtaacgttacgtggtacgtaagttaacgcgggtacgggaacggaccaaaggtcgtacggacccgtcgttacggtaccaaccggacccgaacggttcccgtaacccggccccgtcggtccctaccgttccttcccgttaaccccgtaaccccg

SEQ ID NO: 350389 - DNA, 662 bp, Homo sapiens
  misc_feature: GZ8MTXP01B9QAF.19.59.F04.1.454.CMB.2.raw
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggcccaggacagaagtcacatctcctgctcgtggaagcagcctaccaaactagttagggaatatttttggcgttccgtggtaccagcacgcctacccgaggaaccacgacccccaaactcctctattttagactaaataactaacgccgaccctacgaggtacttcccgtagaccgtattactcgtcggcctacccctaagtcgtcggaccacgtacacgcccacccgtgggctacgtaccgacccggactccgacggtacgtcgggggaacgacgggtacccgtaagtttaacgttacgtacggaccggtaaacgagttagggactacggacggacggtaccgtagtacgttacgtgtagaagtacggtcgggacgggacggaaccgaaggtccgtcggttacccggtccgttacggtaccgaccggacccgacggccgtccgccccgtcggtacctcgttccttccgttcccctaaccg

SEQ ID NO: 350390 - DNA, 578 bp, Homo sapiens
  misc_feature: GZ8MTXP01BHM5F.19.59.F04.1.454.CMB.2.raw
  modified_base (220)..(220): a, c, t, g, unknown or other
  misc_feature (220)..(220): n is a, c, g, or t
  modified_base (247)..(247): a, c, t, g, unknown or other
  misc_feature (247)..(247): n is a, c, g, or t
tcagtactctcgtgcacgaccggtgctcgatttagtacacacacttagggattgggggcagaaggcaggactcgggacaatcttcatcatgacctgctcccctctcctcctcaccattctcattcactgcacagggtcctgggcccagtctgtgttgacgcagccgccctcagtgtctgccggccccaggacagaaggtcaccatctcctgctctggaancagctccaacagttgggaatattttgngtcctggtaccagcagctccaggaacacgccccaaactcctctattttgactaataatagccaccctcaggtacttcctagaccgatttctcgtcggccctccgaagtcgtggccaacgtcaacgcccacccgtgggccagtccgaccggactccagacgtgggggacgacggcccgtaattacgttacctggacgaaacagtaggggatacggggcaagtccctagacgtactggtagaataacgtcgggacggacggaccaaagcttgacccgttcgaggtccacgccaaggcctacgccccgtggtccacgtccgttcgttaaccccc

SEQ ID NO: 350391 - DNA, 698 bp, Homo sapiens
  misc_feature: GZ8MTXP01BVHUC.19.59.F04.1.454.CMB.2.raw
  modified_base (660)..(660): a, c, t, g, unknown or other
  misc_feature (660)..(660): n is a, c, g, or t
  modified_base (667)..(667): a, c, t, g, unknown or other
  misc_feature (667)..(667): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgtcgttgggtttttccttgttgtcttattttagaaggtgtccagtgtgaggtgcagcgtgggtggaggtcgtgggggagtcgttggtacgagccgtgggacgggtccctgacgtaccttctcgtgtcgcgacgtccctgtgtacttacctaccttgtagttagttagtagtaaagtgtaacggttcggacccgcgacggtccgtacgggagggggtaagggcgttagggtagggttcggttactacgtaacgttaggtttaggtaggtaggttaggtaaacgtagtcgtaataacgtacgtacgacgagtaccgtgtaggtacggaaccgggtcctacttaccaacctacttacccgaccgaaggacgaaacccgacgggacccaaaccccgtaaaaggtacccctttacgtaacgttacggtactacggtacgaaacctaaaggaccgtaaacgcggtaccagggaacggcgaccggaagggacccgtaagggtcctttaagttnttacggngtcggaagtagaggttacgtgaagtaagggg

SEQ ID NO: 350392 - DNA, 670 bp, Homo sapiens
  misc_feature: GZ8MTXP01EALTC.19.59.F04.1.454.CMB.2.raw
  modified_base (222)..(222): a, c, t, g, unknown or other
  misc_feature (222)..(222): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagcccgccctcagtgtctgccggccccaggacagaaggtcaccatcctcctgctctggaancagctaccaactagttagggaatattttgtcgtcctggtaccagcacgccacccgaggaaccaccgaccccctaactcctctatttagaaactaataatacgccacctacgaggtacttcccgtagtaccgtattctcgtacggtccctacccgtaagtcgtcggacctaccgtaccaaccgcccgtacccgtcgggacctaccgtccgaacccggacctcccgaacggacggtacggggacgacggaccgttatttaacgttacgtagacggaactagagggtactggacgtacggtcctaggtacgtagtgtagtaagttaacggcgggacggggacgaaccgaggtcctacggaccggtaacgttcggaccacggcccgaacggttccgtccccggtcccgttcggtaccctccgttcccgttcccggtttaaccccccgtcccg

SEQ ID NO: 350393 - DNA, 649 bp, Homo sapiens
  misc_feature: GZ8MTXP01C9202.19.59.F04.1.454.CMB.2.raw
  modified_base (252)..(252): a, c, t, g, unknown or other
  misc_feature (252)..(252): n is a, c, g, or t
  modified_base (362)..(362): a, c, t, g, unknown or other
  misc_feature (362)..(362): n is a, c, g, or t
  modified_base (392)..(392): a, c, t, g, unknown or other
  misc_feature (392)..(392): n is a, c, g, or t
  modified_base (403)..(403): a, c, t, g, unknown or other
  misc_feature (403)..(403): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagcccgccctcagtgtctgccggccccaggacagaaggtcaccatctcctgctctggaagcagctaccaaatagttagggaaatattttgngtcctggtaccagcagcacccaggaacacgacccccaaatcgtacatctaataagtcgacgctaggacgcccgggttaccttaacggggtcccctaggtaccctattccncgtggccgaggtaggtcgtggcctaccctncgtcttcccgngccatcgaggcggctacgagtctagaagtagtgaggtctaggtaacttaattacgtgtagaccgtaaagttcggtagggtatggtaacgtggttggttaccgggttaaccgggttcccggggtttacgggacggggtaacgggtaacccgtaagttccgttaccggacccgttaaccgttaagcccgacgaccccgtaaggtcccgtcccggtcccccgtggttccctaaccgttccgtttccccg

SEQ ID NO: 350394 - DNA, 654 bp, Homo sapiens
  misc_feature: GZ8MTXP01EORE6.19.59.F04.1.454.CMB.2.raw
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
  modified_base (247)..(247): a, c, t, g, unknown or other
  misc_feature (247)..(247): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggccccaggacagaaggtcaccatctcctgctctggaancagctacaanagttagggaatatttgngtctggtacagcagcacccaggaaccacgacccccaaactcctactaatttttagaactaaataaactaacgccgaaccctacgaacgggtacttcccgtagtaccgtattctctcggcctacccaagtctggcacgtacacgcccaacccgtgggacctacgtccgaaccgggacctcccgaaggaccgtagggggaaccgaggtacccgtatttaacgtacgtggacggtaacagtagggaactagacgacgtccgtagacgttagtgtagtaagtaacgtcgggacggaacggaccaaaggtcgtacggttacccgtcgttacggccaacggacccgacggttcccgtcccggtcccccgtaacggttccctaccgttcccgttcccggttccccctaaccccg

SEQ ID NO: 350395 - DNA, 674 bp, Homo sapiens
  misc_feature: GZ8MTXP01AWD2W.19.59.F04.1.454.CMB.2.raw
  modified_base (266)..(266): a, c, t, g, unknown or other
  misc_feature (266)..(266): n is a, c, g, or t
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
tcagtactctcgtgcacgaccggtgctcgatttagtacacacacttagggattgggggccctagccctggattccaaggcatttccacttggtgatcagcactgaacacagaggactcaccatggagttggggctgtgctgggttttccttgttgcttattttagaaggtgtccagtgtgaggtgcagctggtggagtcgtgggggagcttggtacagcctgggagggtcctgagactctcctgtgcagcctctggattcaccttnagttagttangaaatgaattgggccncgaggctccgaggggagggctggagtgggtttcagtactagtttaggtagtaggtggtaagtagactatatacgtacgcagaaaccttcgtggtaggaaacgggggccctactttaccgaccctaattcccgtacccgaagaacgaacgacggacccgacccgaaaagaaccttacaaccgttagtaacttcctagaacctaaaaagtcggaaaaccaacggtcccgtaggaaacgaccggaacccgggaagggaaccaccgggtaccttagtttttaaacgtaacgttggttcggaggagggtaaggtacgggttaggacgaaagggttgggagggggttaaccgaagttaggtttagggtaacggttgggggttaacggg

SEQ ID NO: 350396 - DNA, 657 bp, Homo sapiens
  misc_feature: GZ8MTXP01B154C.19.59.F04.1.454.CMB.2.raw
  modified_base (259)..(259): a, c, t, g, unknown or other
  misc_feature (259)..(259): n is a, c, g, or t
  modified_base (282)..(282): a, c, t, g, unknown or other
  misc_feature (282)..(282): n is a, c, g, or t
  modified_base (302)..(302): a, c, t, g, unknown or other
  misc_feature (302)..(302): n is a, c, g, or t
tcagtactctcgtgcacgaccggtgctcgatttagtacacacacttagggattgggggccctagccctggattccaaggcatttccacttggtgatcagcactgaacacagaggactcaccatggagttggggctgtgcttgggttttccttgttgcttattttagaaggtgtccagtgtgaggtgcagcgtggtggagtcgtgggggagtcttggtacagccgtgggacgggtccctgagactctcctgtgcagcctntggacttcaccttcagtagttanagaaatgtaagttcgggccncaggcctacggaaggggaggggctgggtagttgggtttacagttacgtagtttaggtaggtaggtaggtaagtagctaatactactacgcagtaactgtggtacgaaacggggtcctaattccgaacttactttacccgaagtacgacacgccgaaccaaacgtaacctctaacttgtaactctacgaactaaagtacggaaactacggtacctaggaacgacggacccggtaaggacgacggtacttaagtttacgttacgtggtaggacggaggaggtaggtacggacgttaagggttgggtaaggggtacggtaattaggttagggttagggttgggtttaagggttaacgg

SEQ ID NO: 350397 - DNA, 506 bp, Homo sapiens
  misc_feature: GZ8MTXP01A0L9A.19.59.F04.1.454.CMB.2.raw
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
  modified_base (309)..(309): a, c, t, g, unknown or other
  misc_feature (309)..(309): n is a, c, g, or t
  modified_base (413)..(413): a, c, t, g, unknown or other
  misc_feature (413)..(413): n is a, c, g, or t
  modified_base (436)..(436): a, c, t, g, unknown or other
  misc_feature (436)..(436): n is a, c, g, or t
  modified_base (456)..(456): a, c, t, g, unknown or other
  misc_feature (456)..(456): n is a, c, g, or t
  modified_base (483)..(483): a, c, t, g, unknown or other
  misc_feature (483)..(483): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
  modified_base (501)..(501): a, c, t, g, unknown or other
  misc_feature (501)..(501): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctgggtggagtcgtgggggagcttggtacagcctgggagggtccctgagactctcctgtgcagccnctggattcaccttnagtagttatgaaatgaattgggccncaggctcgagggagggctggagtgggttcataccagttagtagtagtggtaatagcatatactacgcagactctgtagaagggccattcacatctccagagacngcgaccaaaggtactcactgtancctagacaatagaacagccngaagacgacgaggacgacgcttagttnttatgtgngngagagtgngaagg

SEQ ID NO: 350398 - DNA, 725 bp, Homo sapiens
  misc_feature: GZ8MTXP01ENHO5.19.59.F04.1.454.CMB.2.raw
  modified_base (697)..(697): a, c, t, g, unknown or other
  misc_feature (697)..(697): n is a, c, g, or t
  modified_base (707)..(707): a, c, t, g, unknown or other
  misc_feature (707)..(707): n is a, c, g, or t
tcagtactctcgtgcacgaccggtgctcgatttagtacacacacttagggattgggggcagctctcagagaggtgccctagccctggattccaaggcatttccacttggtgatcagcactgaacacagagactcaccatggagttgggctgtgtcgttgggttttccttgttgtcttagttttagaaggttgtccagtgtgaggtgcagcgtgggtggaggtcggtgggggagtcgttggtacacggtccgtgggacgggtccctagacgtaccttcgtcctggtacgcacgtccctcgtacggtactttccgtaacctttcgtaaaggtttaagttaagtaagtaaaacgtttgggtaaacgtttccgggggtacccccaccggaagggtcccgttaccggggaaaggggggtaacgggggtcgttaggggtaggtttcgggtttacaagtttaaccgtagttttaggtaaggttaggttacgggtaaagtagctaaattaacgtacctacgactacgtaccgttgtaggtacggaacggtcgtaattcccaactaacttcccacgaaggacgaacccgaggacccgaaccaaaacgggtactcgtaaacgttgtaactcgaacaataaaagtacgaacgacgtcggaaggaacggcggaccggaaagccgtagtactttagtttacttagtcggngaacgtaggnggttagtcggaagtgggg

SEQ ID NO: 350399 - DNA, 636 bp, Homo sapiens
  misc_feature: GZ8MTXP01BMI6O.19.59.F04.1.454.CMB.2.raw
  modified_base (264)..(264): a, c, t, g, unknown or other
  misc_feature (264)..(264): n is a, c, g, or t
  modified_base (598)..(598): a, c, t, g, unknown or other
  misc_feature (598)..(598): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttgggctgtgctgggttttcctgttgctattttagaaggtgtccagtgtgaggtgcagctggtggagtcgtgggggagcttggtacagccgtgggaggtccctgagtactctcctgtgcngcctgtggacttccaccttcgagttagttatagaaatggtaagttcggggtcccgaccgacgggccgttaccggaagggggtaacggggtcgttgggggagttggggtttacagtacccgtagttaggtagtaggtggtaagtagctatactacgtacgcgtacgtactcgtaggtagaacggggcctagttccacctatccgtcaagagaccacgaccgaacccaaaggggaactcgaacgtgtaactcgtagactaaaagtcgaaacgtcgtaccgtgggaacgaacggacccggaaggacccgttaaccggtcttaaaggttttcttacgnggtaggaacggagagggttacgggtggaacgtaagggg

SEQ ID NO: 350400 - DNA, 616 bp, Homo sapiens
  misc_feature: GZ8MTXP01A2BFS.19.59.F04.1.454.CMB.2.raw
  modified_base (237)..(237): a, c, t, g, unknown or other
  misc_feature (237)..(237): n is a, c, g, or t
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
  modified_base (393)..(393): a, c, t, g, unknown or other
  misc_feature (393)..(393): n is a, c, g, or t
  modified_base (487)..(487): a, c, t, g, unknown or other
  misc_feature (487)..(487): n is a, c, g, or t
  modified_base (573)..(573): a, c, t, g, unknown or other
  misc_feature (573)..(573): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgcttgggttttccttgttgcttattttagaggtgtccagtgtgaggtgcagctgggtggagtcgtgggggagtcgttggtacngccgtgggacggtccctgagctctctgtgcngccntgattcaccttnagtatanagaaatgtaagttcggccncgaggctacggagggggaggtctagggtagtggttcataccgtagttaggtagtaggtaggtaatagctaatactacgtacgnaggtactcgtaggtacggaacgggtcctattaccgactactcctaccaggacacgacgaccgaaccctaaggaacctcgtaacgttgttaaccncgtaagaactaaagtcgaaccgacgtccgtaaggaacgtaccggaccggtaaaggaccgtaacggtactttaaggtttcttacggnggtacggaacggtaaggacggttagggtcggaacggtaagggg

SEQ ID NO: 350401 - DNA, 718 bp, Homo sapiens
  misc_feature: GZ8MTXP01ARMO2.19.59.F04.1.454.CMB.2.raw
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggccccaggacagaagtcaccatctcctgctctggaagcagcctaccaaactagttaggggaattaattttgtcgtcctggtaccagcacgcacccgaggaaccaccgacccccaaactcctactattttacgaactaaataaataacgaccgtaccccgtacgacgggtacttcccgtacgtaccgtattcctcgtcggcctacccgtaacgtcgtcggacctaccgtaccaaccgccccgtaacccgtcggggaccctacgtacccgacccggtacctacccgaacggtaccggtacgggggaaccgacgggtacccgtaagtttaaccgttacgtacggacggtaaacgagtagggactacggcgaacgtccgtaggacgttacgtgtagtaacgtaacgtcggggaccgggaacgggaaccaaggtcgtacggttacccggtaccgttacgggtccaaccggttacccgacggcccgtaacccgtccccgtaacggtcctaccgttccgttaacccgttcccccgtaaccccg

SEQ ID NO: 350402 - DNA, 589 bp, Homo sapiens
  misc_feature: GZ8MTXP01AZV9H.19.59.F04.1.454.CMB.2.raw
  modified_base (223)..(223): a, c, t, g, unknown or other
  misc_feature (223)..(223): n is a, c, g, or t
  modified_base (297)..(297): a, c, t, g, unknown or other
  misc_feature (297)..(297): n is a, c, g, or t
  modified_base (325)..(325): a, c, t, g, unknown or other
  misc_feature (325)..(325): n is a, c, g, or t
  modified_base (415)..(415): a, c, t, g, unknown or other
  misc_feature (415)..(415): n is a, c, g, or t
  modified_base (497)..(497): a, c, t, g, unknown or other
  misc_feature (497)..(497): n is a, c, g, or t
  modified_base (507)..(507): a, c, t, g, unknown or other
  misc_feature (507)..(507): n is a, c, g, or t
  modified_base (560)..(560): a, c, t, g, unknown or other
  misc_feature (560)..(560): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggtttccttgttgctatttagaaggtgtccagtgtgaggtgcagctgggtggagtcgtggggganacttggtacagcctgggagggtccctgagtactctctgtgcagccctctggtacttcacctttcagttagttanggaaaatggtaagtttcgggggtacccnccgaagggcctaccggaagggggaagggggctaggggaggttgggtttcagtaccattagtaggtagtggtaagagcaatactactacgnagactctaggtgaaacggggtccaattccaacatcctaccagagacagcgacctaaaggactcgactagtaactgtacgaanaaatcgaacncggccaggaacgacggcggaacggacgtacgggtcttaagtttcttacgtggngaacggaagaggaggtcggaacgtaaggg

SEQ ID NO: 350403 - DNA, 735 bp, Homo sapiens
  misc_feature: GZ8MTXP01CEWFQ.19.59.F04.1.454.CMB.2.raw
  modified_base (207)..(208): a, c, t, g, unknown or other
  misc_feature (207)..(208): n is a, c, g, or t
  modified_base (217)..(217): a, c, t, g, unknown or other
  misc_feature (217)..(217): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcacgccgccctcagtgtctgccggcccaggacagagtcaccatctcnnctctggaancagctacaatagttaggaatattttgcgtcctggtacagcacgccacccgacggaaccaccgacccctaactcctactattttagaactaaataactaacgccgaccctacgacgggtacttaccgtacgtaccgtacttcctacgtcggtcctaccccgtaacgttcgtacggtaccctaccgtaacccgacccgtccccgtaccccggtcggggaccctaccgtacccgaaccccgggtacctacccgacggtaccggtacgggggaaccggtacgggtaccgttagtttaacgttacgtacggaacggaaacgtaggtagggaactacggacgtacggtaccgttaggtaacgttacgtggtagtaacggtaacggtccggggtaacggggaaccggtaaccgaacgggtccgtaacgggttaccgtaccggttaacggtaccgaccggacccgacggttcccgtcccgtccccgtcggtcctaccgttcccgttaacccgttcccctaaccccg

SEQ ID NO: 350404 - DNA, 573 bp, Homo sapiens
  misc_feature: GZ8MTXP01B3PF9.19.59.F04.1.454.CMB.2.raw
  modified_base (228)..(228): a, c, t, g, unknown or other
  misc_feature (228)..(228): n is a, c, g, or t
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
  modified_base (258)..(258): a, c, t, g, unknown or other
  misc_feature (258)..(258): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctgaagcagctccaanttgggaanattttgngtctgtacagcagcncccaggaacacgcccccaaactcctcatttttgaactaaataataagccgaaccctacagggactttcctcgaccgtattcctctggctaccccaagtctaggcacgtcacgccaccctgggcactcgaccggactccagacgtgggacgagccgattataactgacggaacagtgggatagcgagtccgtagaacgtctgtagtagtaaacgtcgggccgggaggacccaaaggcctacggacctccgttacggtcacggacccgaagggcctcggccccctggtcccacgttcctccgttccccgtaaccccg

SEQ ID NO: 350405 - DNA, 696 bp, Homo sapiens
  misc_feature: GZ8MTXP01ETY8O.19.59.F04.1.454.CMB.2.raw
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
  modified_base (248)..(248): a, c, t, g, unknown or other
  misc_feature (248)..(248): n is a, c, g, or t
  modified_base (510)..(510): a, c, t, g, unknown or other
  misc_feature (510)..(510): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggccccaggacagaaggtcaccatctcctgctctggaancagcctacaanagttgggaatattttgngtcctggtaccagcacgctacccgaggaaccacgacccccaactcctactattttagaactaaataagtacgccgaaccctcgacgggtacttcccgtacgaccgtattcctcgtcggccttccccgaaggttcgtcggacctaccgtaacaccgccctacccgtcggggacaacgtcccgaacccggggtaccttacccgacggtaccggtacgggggaaccgacgggtacccgtatttaacgtacgtcggaaccggtaanacgtgggaatacgcgtacggcgtagtacggtacgttcggagtaagttaacggcggggtacgggaacgggtaccgaaacgtcgtacggttaccggtccgaaggtaccgacggacccgttagggttccccgtaacccggtcccccgtcggtaccctccgttcccggtaacccgttccccctaaccccg

SEQ ID NO: 350406 - DNA, 703 bp, Homo sapiens
  misc_feature: GZ8MTXP01A0D78.19.59.F04.1.454.CMB.2.raw
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (248)..(248): a, c, t, g, unknown or other
  misc_feature (248)..(248): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagcccgccctcagtgtctgccggccccaggacagaaggtcaccatctcctgctctggaancagctcaanagttagggaatatttgtntcctggtaccagcagctcccaggaacacgccccaaactcctctattttgacaaataataagccgaccctgagggtacttccgtgaccgtattctactggctacccaagtctggacacgtcacgcccaccgtggaccactccgaccgctccagacgtggggaccaggccctaagttacgtacgtcggacggaacgagtaggggaacttacggacgtaacggtacccgtaggtaacggttaccgttagggtagtaaacgtttaacgggtccgggggtaacggggtaaaccgggggaaaccaaacggggtcccgttacccgggttaaacccgggttaccccgttaaacgggtacccgtaaccgggaccccgttaaacgggggttcccctaaccccgggtacccccccgtcgggggttacccctaccttaccccgtttccggtttaaccccctccccgg

SEQ ID NO: 350407 - DNA, 631 bp, Homo sapiens
  misc_feature: GZ8MTXP01CTNWP.19.59.F04.1.454.CMB.2.raw
  modified_base (218)..(218): a, c, t, g, unknown or other
  misc_feature (218)..(218): n is a, c, g, or t
  modified_base (246)..(246): a, c, t, g, unknown or other
  misc_feature (246)..(246): n is a, c, g, or t
  modified_base (256)..(256): a, c, t, g, unknown or other
  misc_feature (256)..(256): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggcccaggacagaaggtcaccatctcctgctctggaancagcctcaacagttagggaatattttgntcctgtaccngcacgctcccgaggaaccacgacccccaactcctactattttagaactaataaataacgcccgaccctgacgggtacttcccgtgaccgtatttcgcgttcggtcctaccccgtaagttcgtaggccacgtccacgtcccacccgtgggacctacgtccgacccggactaccgacgtacggtcggggacgaggacccgtattacgttacgtcggaccggaacaaggtagggtaacgtacggacgtacgtaccccgtagaacgttacgtagtagaagtaacgtcgggaacgggacggaccgagcgtacgaccggtcttacggtcacggttccgacggcctaaccgccccgtcggtcctcgttactccgttccgtcc

SEQ ID NO: 350408 - DNA, 850 bp, Homo sapiens
  misc_feature: GZ8MTXP01ED31T.19.59.F04.1.454.CMB.2.raw
  modified_base (261)..(261): a, c, t, g, unknown or other
  misc_feature (261)..(261): n is a, c, g, or t
tcagtactctcgtgcacgaccggtgctcgatttagtacacacacttagggattgggggcagctctcagagaggtgccctagccctggattccaaggcatttccacttggtgatcagcactgaacacagagactcaccatggagttgggctgtgtcgttgggttttccttgttgtcttagttttagaaggtgtccagtgtgaggtgcagcgtgggtggagtcggtgggggagtcgttggtacagtccgtgggtacggtcccngacgtaccttctccgtgtcgcacgtcctcgtggtacttcctaacctttcgaaagtttagtttaagtaaggtaaaacgttggtaaggtttcgggggtacccccgaccggtaaggtcccggttacccggggaaggggggtaacgggggtccgttagggggttacgggtttacgggtttaaccaagtttaacccgtaaggttttaaggtaaggtttagggtaggttaaagtacgtaacgttaataaaccgttaaaccgtaccgacgtaacgttacccttacgttagggtaacgggtaaccggggtcccttaactttaccccgaacccttaactttaccccgtaaccgaaggacgaaacccgtaccggaacccgaaccccgaaaacggggtaaaccctttccgtaaacgtttacggttaaacttcccgtaaaggaaacctaaaaaagtcggtaaaaccaccggttaccgaagggaaaccggttacgggaccccggaaaggggttaaccctacggggtacctttaagggttttttcaaccgggtggttaaacgggcggtaagggtaggttacgggttaacggaacggttaaggg

SEQ ID NO: 350409 - DNA, 709 bp, Homo sapiens
  misc_feature: GZ8MTXP01ADDNX.19.59.F04.1.454.CMB.2.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (271)..(271): a, c, t, g, unknown or other
  misc_feature (271)..(271): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaagtcaccatctccngctcgtggaancagcctaccaaactagttagggaattaattttgtgtcctggtaccagcagcnccgagacacgccccaaactcctctattttgaactaaataactaacgccgtaccctacgagggtactttacccgtacgaaccgtattcctacgtcggtcctaccccgtaagttccgtgggtaccctacggttaaccgaccgccccgaacccgttcggggacctaactcccgaaccggggtaccttacccgaacggtacggtacgggggtaccgacggtaccgtagttaacttacggtgaccggtaagacgttaggggatacggacgtacgaccgtagaacgttaccgtgtacgtaagttaaacgggtccggggaacgggggtaacggaaacccgaaagtccgtaaccggttaccgtaccgacggttaccgacgacccgttaacggttcccgtaacccgcccctcgggccctaccgttctaacccgttcccctaaccccg

SEQ ID NO: 350410 - DNA, 820 bp, Homo sapiens
  misc_feature: GZ8MTXP01BI7VD.19.59.F04.1.454.CMB.2.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (249)..(249): a, c, t, g, unknown or other
  misc_feature (249)..(249): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagcccgcctcagtgtctgccggcccaggacagaagtcacatctcngctctggaancagctaccaatagttagggaatatttgcgtccngtaccagcagctccagaacacgaccccaaactccctactatttttagaaactaaattaaataacgacccgtacccgtacgtaacggggtactttacccgttacggacccgttatttcccgttcgtcggggtacccttacccccgaaaggttccgttaggggaccctaaccgggtttacccaaaccggtccccccgtaaaccccgggttccgggggaaccctaacccggttaccccggtaaccccggggaacccgttaccccgaacgggtaccgggtacggggggtaaccgacgggtaccccggtaatttaaccgttacgttacggacggtaaccagggtaggtaagtacggacggtacgtacccggtagtacgtaccgtagtagtaacgttaacgggtccggtacgggggaaccggtaaccggaaagtcccggttaacggaccccggttaaccttacggggttaacccgacccggaccccggttaaacgggttcccgtaaccccgggtccccccgttcggggttaacccctaccgtttaccccggtcccggttttcccccctaaccccccg

SEQ ID NO: 350411 - DNA, 805 bp, Homo sapiens
  misc_feature: GZ8MTXP01BLNY3.19.59.F04.1.454.CMB.2.raw
  modified_base (206)..(206): a, c, t, g, unknown or other
  misc_feature (206)..(206): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttgggctgtgcttgggttttccttgttgcttattttagaaggtgtccagtgtgaggtgcagngtgggtggagtcggtgggggagtcgttggtacaggccgtgggtacgggtccctagacgaccttctccgtgtacgcacgtcctcgtggtacttccaccttcgaagttagttaatagtaaagttagtaacgtttcgggggtccccgaccgacggtccgtaccgggaagggggtaagggggtccgttagggggttaggtttacggggtttactaagttaaccgttaggtttaaggtaggttaggttagggttaaacgtagcgtaaattacgtaaccgtacgacgtacgtacgttcgtagggtaggaaaccgggtcctaacttaccaaacccgttacgtttacccgaccgtaaaggaacccggtaaacgaacccggaacccgaacccgtaaaaacgggtaaaccctttacccgtaaaccgtttcggttaaattcccggtaaagtaaccgtaaaaaacgttaacgtaaaacccgagggaccccgttaagggaaacgggtccggaaccggggaaacggaaccgttaaccggtaacgttttaagttttacgtttaccgtaagggcgtaagaggtaagggttccggtaagggttaacgggtaagggg

SEQ ID NO: 350412 - DNA, 588 bp, Homo sapiens
  misc_feature: GZ8MTXP01AH529.19.59.F04.1.454.CMB.2.raw
  modified_base (278)..(278): a, c, t, g, unknown or other
  misc_feature (278)..(278): n is a, c, g, or t
  modified_base (433)..(433): a, c, t, g, unknown or other
  misc_feature (433)..(433): n is a, c, g, or t
tcagtactctcgtgcacgaccggtgctcgatttagtacacacacttagggattgggggccctagccctggattccaaggcatttccacttggtgatcagcactgaacacagaggactcaccatggagttggggctgtgctgggttttccttgttgctatttagaaggtgtccagtgtgaggtgcagctggtggagtcgtgggggaggcttggtacaggcctgggacgggtccctgagtactctcctgtgcagcctctggacttcaccttcagtattanagaaatgaattcgggtccgccaggctccgaggggaggggctgggagtgggttcatacattagtagtagtggtagtagactagtatacgtacgcagtaactcgtgtagaaacggggcctattcacctatttcccagacgacagcgaccaaagaccncactgtatctagactaaatcggaaacacgcctaggaacgacggacccggaagggaccaacgggtctaacgtttactacgtggtcgaggagaagtaggtcggagaaggttggaaggggtcgtaagtaagttgggttaggttgggttcggttaaggg

SEQ ID NO: 350413 - DNA, 665 bp, Homo sapiens
  misc_feature: GZ8MTXP01B6A3F.19.59.F04.1.454.CMB.2.raw
  modified_base (260)..(260): a, c, t, g, unknown or other
  misc_feature (260)..(260): n is a, c, g, or t
  modified_base (275)..(275): a, c, t, g, unknown or other
  misc_feature (275)..(275): n is a, c, g, or t
  modified_base (438)..(438): a, c, t, g, unknown or other
  misc_feature (438)..(438): n is a, c, g, or t
  modified_base (482)..(482): a, c, t, g, unknown or other
  misc_feature (482)..(482): n is a, c, g, or t
tcagtactctcgtgcacgaccggtgctcgatttagtacacacacttagggattgggggccctagccctggattccaaggcatttccacttggtgatcagcactgaacacagaggactcaccatggagttggggctgtgcgttgggttttccttgttgcttattttagaaggtgtccagtgtgagtgcagctggtggagtcgtgggggagtcgttggtacagccgtggacgggtccctgacgactctcctgtgcacgcctntggtattccaccttnaagttattatagtaaatgtaagttcggtccgcgaggtcctacggaaggggaggggtcgtagggtggttggtttacagttacgtaagtttaggtaggttagttacgggtatagtctaattactacgtacgctagtaactcgtggaggaacgggcctatcacctntctacagacgacacgcacgaaacgactacgtatcgtactcgtanaactaaagtacgaacgtacgaccgtagaacggacgccggaacggaccgtacggtacgttaacgtttaacgtaacggtggttacggtacggaggtaacggtagggttaccggttagttaaacgggggtgggtaacggggttaaccggtagttaggtttagggttaacgggttggggtttaaggg

SEQ ID NO: 350414 - DNA, 857 bp, Homo sapiens
  misc_feature: GZ8MTXP01DPW5L.19.59.F04.1.454.CMB.2.raw
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcacgcccgcctcagtgtctggccggccccaggacaggaaggtcaccatcctcctgctcgtaggaagcacgcctacaaactagttaggggaaattatttttggcgttccgtaggtaccagcacgccaccgaagaaccaccgaccccaaactcctactattttacgaaactaaataaacgtaacgaccgtaaccctacgtacgggtactttcccgtacgtaccgttacttccgtcgtacggtcctaccccgtaacggtcgtcgggaccctacgtaccaaccgccccgtaaacccggtcgggaccctacgtacccggtaacccgtaccgtacccgtaacgggaccgggtacggggaaccgggtaacgggtacccgttaaacgtttaaacggttaccggttaacggtaacccgggaaaacggttacggttaacggggtaaagttaaccgggaaccggtaacgggttacccgttaagggttaaaccggttaccgttagggttaacggttaaaaggtaaccggggtaccgggtaccgggggaaacggtaaccgaaacgggtcccgttaacgggttaccccggttaccggttacgggtaacccgaccggttaacccggaccggggttaccccttaaccccgggtaccccggttcccggtaccgttaccccggttccgttcccccgttcccccggttaacccccg

SEQ ID NO: 350415 - DNA, 637 bp, Homo sapiens
  misc_feature: GZ8MTXP01AWMW0.19.59.F04.1.454.CMB.2.raw
  modified_base (199)..(199): a, c, t, g, unknown or other
  misc_feature (199)..(199): n is a, c, g, or t
  modified_base (268)..(268): a, c, t, g, unknown or other
  misc_feature (268)..(268): n is a, c, g, or t
  modified_base (515)..(515): a, c, t, g, unknown or other
  misc_feature (515)..(515): n is a, c, g, or t
  modified_base (549)..(549): a, c, t, g, unknown or other
  misc_feature (549)..(549): n is a, c, g, or t
  modified_base (568)..(568): a, c, t, g, unknown or other
  misc_feature (568)..(568): n is a, c, g, or t
  modified_base (575)..(575): a, c, t, g, unknown or other
  misc_feature (575)..(575): n is a, c, g, or t
  modified_base (615)..(615): a, c, t, g, unknown or other
  misc_feature (615)..(615): n is a, c, g, or t
  modified_base (619)..(619): a, c, t, g, unknown or other
  misc_feature (619)..(619): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttgggctgtgcttgggttttcctgttgctatttagaaggtgtccagtgtgaggtncagctgggtggagtcgtggggggagtcgttggtacaggcctgggacgggtccctgagtactctcgtgtncacgtcctgtggtacttccgaccttagagttaacgttatagtaaagtggtaagtttcggggtcccgaccgagggtccgtaccggaaggggggaacggggtcgttagggtaggttacggggtttacaagttaaccgttaagtttaggtaaggtaggtaggtaagttacgaatataataccgtacgctaagcttcgtagggtagaaacgggtccaattcccaactacgttacgaccaagggacaaaccnggaccttaccaaagggactcgaatcgtactaccngaaactaaagtacgaaacncgtaccnggaacgacgcggtagaacgcggtaacttgtttattaccgngagngagagagtggaagtaagg

SEQ ID NO: 350416 - DNA, 527 bp, Homo sapiens
  misc_feature: GZ8MTXP01AKZXS.19.59.F04.1.454.CMB.2.raw
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
  modified_base (397)..(397): a, c, t, g, unknown or other
  misc_feature (397)..(397): n is a, c, g, or t
  modified_base (418)..(418): a, c, t, g, unknown or other
  misc_feature (418)..(418): n is a, c, g, or t
  modified_base (452)..(452): a, c, t, g, unknown or other
  misc_feature (452)..(452): n is a, c, g, or t
  modified_base (458)..(458): a, c, t, g, unknown or other
  misc_feature (458)..(458): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgcctcagtgtctgcggccccaggacagaaggtcaccatctcctgctctggaancagctccaaanttgggaaataattttgngtcctggtaccagcagctcccaggaacagcccccaaactccctacatttttgacaaataaactaaancgaaccctnagggattcctgaccgattactctggctcccgaaatctggcacgtcagccacctgggcatcaccggactccagacngggacgaggccgattattacngcggaacatgggatagcagcctgacgtatggtanatacgnggacgaggacagctcgacgtcgagcgacgaccgacgctcgcccgtcgtcacttcgtccgttcccgtccc

SEQ ID NO: 350417 - DNA, 620 bp, Homo sapiens
  misc_feature: GZ8MTXP01EWL6J.19.59.F04.1.454.CMB.2.raw
  modified_base (185)..(185): a, c, t, g, unknown or other
  misc_feature (185)..(185): n is a, c, g, or t
  modified_base (298)..(298): a, c, t, g, unknown or other
  misc_feature (298)..(298): n is a, c, g, or t
  modified_base (316)..(316): a, c, t, g, unknown or other
  misc_feature (316)..(316): n is a, c, g, or t
  modified_base (577)..(577): a, c, t, g, unknown or other
  misc_feature (577)..(577): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttcctgttgctattttagaggtntccagtgtgaggtgcagctgggtggagtcgtggggggagcttggtacagccgtgggacgggtccctgagactctcctgtcgcacgtcctctggacttcaccttcagtagttangaaatgaagttggggccncgaggctaccggagggggagggctgggagttgggtttacagttaccgatttaggtagtaggtaggtaaagtagcattaataccgtacgactagactcgtaggtacggaaagggtccctaattccaacctatccgtaccaagacgacacggaccacgaaacgggtactacgtaactcgttaaatccgtagtaaccaaaattcggaaaactcgaccgtaggaacgacgggttaccggaacggacgtacgggtacttaagtttnttaccgtggtagaacggtagaggttaggtgggaacgtaagggg

SEQ ID NO: 350418 - DNA, 686 bp, Homo sapiens
  misc_feature: GZ8MTXP01BSHDA.19.59.F04.1.454.CMB.2.raw
  modified_base (170)..(170): a, c, t, g, unknown or other
  misc_feature (170)..(170): n is a, c, g, or t
  modified_base (217)..(217): a, c, t, g, unknown or other
  misc_feature (217)..(217): n is a, c, g, or t
  modified_base (515)..(515): a, c, t, g, unknown or other
  misc_feature (515)..(515): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgcctnagtgtctgccggcccaggacagaagtcaccatctcctgctctggaancacgctaccaatagttgggaatattttgacgtcctggtaccagcagtcaccgagaaccacgacccccaaactcctactattttcgaaactaaataagtaacgccgtaaccctacgaacgggtactttccgtacgacgtactttcctacgtcggtacctaccccgtaaacgttcgtacggtccctacgtaaccgaccgccctaacccgtcggggtaccacgtacccgaccggtacctaccgacgtacggtagggggaaccgtagggtaccgtaactttacgtacgtacgacggtaaacnggtacggtagtacgacggaacgtcgtagtaagtcgtagtacgtaatacgtcggacggacgtacgaggtctacggaccgtaccggttagtaccgaacggacccgttaacgggttcctaacccggtaccccgtcggtacctccggttccttaacccggttcccctaaccccgg

SEQ ID NO: 350419 - DNA, 577 bp, Homo sapiens
  misc_feature: GZ8MTXP02J4WN8.19.59.F04.1.454.CMB.2.raw
  modified_base (219)..(219): a, c, t, g, unknown or other
  misc_feature (219)..(219): n is a, c, g, or t
  modified_base (419)..(419): a, c, t, g, unknown or other
  misc_feature (419)..(419): n is a, c, g, or t
  modified_base (522)..(522): a, c, t, g, unknown or other
  misc_feature (522)..(522): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggccccaggacagaagtcaccatctcctgctctggaancagcctaccaaactagttagggaaatattttgtgtcctggtaccagcagcctcccaaggaaccacgcccccaaactcctctattttagacaaataataacgccgacctcgaggtcttcctgaccgtattcctctggcctcccaagtctggcacgtccacgcccacccgtgggccatccgaccggactcccgagtaaccgnggggacaggcccgatttagtactgacggaaacagtgggatagcagtcctagacggtatgtagaatagcgggcgagggaccaagtcacgccgtacgaccccgtnaccgaccctaaggccctccgcccccgtcggcctacctcctccggtcccctacccc

SEQ ID NO: 350420 - DNA, 575 bp, Homo sapiens
  misc_feature: GZ8MTXP02H1F4L.19.59.F04.1.454.CMB.2.raw
  modified_base (247)..(247): a, c, t, g, unknown or other
  misc_feature (247)..(247): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatcctcctgctctggaagcagctccaacattgggaataattttgngtcctggtaccagcagctccaggacagccccaaactcctcattttgacaataataagcgaccctcagggattcctgaccgattctctggctcccaagtctggcacgtcacgccaccctgggccatccaccggactcccagacgtggggacgaggcccgattaacttacgtgacggaacagtagggatagcagcctgagtactggtgaataaacgtcgggacgggaacggggaaccaaaaggcctaggaacccgtaccgtaggggtaccacggaccccaaagggccttcggaccccctcgggttccaccgtcctcgtttcccccgcccc

SEQ ID NO: 350421 - DNA, 513 bp, Homo sapiens
  misc_feature: GZ8MTXP02II3J6.19.59.F04.1.454.CMB.2.raw
  modified_base (248)..(248): a, c, t, g, unknown or other
  misc_feature (248)..(248): n is a, c, g, or t
  modified_base (317)..(317): a, c, t, g, unknown or other
  misc_feature (317)..(317): n is a, c, g, or t
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaaacattggggaataattttgngtccctggtaccagcagctcccaggaacagcccccaaactcctcattttgacaataataagcgaccctnagggattccctgaccgattctctggctccccaagtctggcacgtcagccaccctgggcatcacggctccagactggggacaggccgattattactgcggaacatgggatagcagcctgagtactgtgataancggnggagggacaagctgacgcctaggcagccaaggctgccccctggtcactctcgtcccaccc

SEQ ID NO: 350422 - DNA, 526 bp, Homo sapiens
  misc_feature: GZ8MTXP02IXCJL.19.59.F04.1.454.CMB.2.raw
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (311)..(311): a, c, t, g, unknown or other
  misc_feature (311)..(311): n is a, c, g, or t
  modified_base (438)..(438): a, c, t, g, unknown or other
  misc_feature (438)..(438): n is a, c, g, or t
  modified_base (445)..(445): a, c, t, g, unknown or other
  misc_feature (445)..(445): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaanttgggaatattttgngtcctggtaccagcagctccaggaacagcccccaaactcctcattttgacaataataagcgaccctnagggattcctgaccgtattctctggctcccaagtctgcacgtcacgccacctggccatccaccggactccagactggggacgaggccgattattacctgcgaacagtgggatagcagcctgagtacngtgatancggcggagacaagctagaccgtcgtaggacacgaccgaagccgtaacgccccgtcgcctactccgtccgtccccgtccccg

SEQ ID NO: 350423 - DNA, 552 bp, Homo sapiens
  misc_feature: GZ8MTXP02IQJYG.19.59.F04.1.454.CMB.2.raw
  modified_base (229)..(229): a, c, t, g, unknown or other
  misc_feature (229)..(229): n is a, c, g, or t
  modified_base (313)..(313): a, c, t, g, unknown or other
  misc_feature (313)..(313): n is a, c, g, or t
  modified_base (461)..(461): a, c, t, g, unknown or other
  misc_feature (461)..(461): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaanattgggaataatttgtgtcctggtaccagcagctcccaggaacacgcccccaaactcctcattttgacaataataagcaccctnaggattccctgaccattctctgctcccaagtctggcacgtcacgccacctgggcactccgaccggactccagacgtggggacgacggccgaatttatacgtgacggtaaacagtgggatacgcagcctgagtactgtgatagtcgggnggacggacaacgctaggacccgtctaaacgggtcacgacccaaggcctcgcccccgtcggttacaccgttccgttccgtccccgtcccccg

SEQ ID NO: 350424 - DNA, 537 bp, Homo sapiens
  misc_feature: GZ8MTXP02IO71D.19.59.F04.1.454.CMB.2.raw
  modified_base (230)..(230): a, c, t, g, unknown or other
  misc_feature (230)..(230): n is a, c, g, or t
  modified_base (313)..(313): a, c, t, g, unknown or other
  misc_feature (313)..(313): n is a, c, g, or t
  modified_base (332)..(332): a, c, t, g, unknown or other
  misc_feature (332)..(332): n is a, c, g, or t
  modified_base (441)..(441): a, c, t, g, unknown or other
  misc_feature (441)..(441): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaaanattgggaataatttgtgtcctggtaccagcagctcccaggacacgcccccaaactcctcattttgacaataatagcgaccctnaggattcctgaccgattcnctggctcccaagtctggcacgtcacgccacctggcactccacggactccagactggggacaggccgtaattatactgcggaaacagtgggatagcaagcctagagtacngtagaatagtcgggacggaagggaccaaagctaggaccgtccgtaaggcacgaccctaagcctcgccccctcggtcactcctacgttcccaccccg

SEQ ID NO: 350425 - DNA, 634 bp, Homo sapiens
  misc_feature: GZ8MTXP02IWEEM.19.59.F04.1.454.CMB.2.raw
  modified_base (256)..(256): a, c, t, g, unknown or other
  misc_feature (256)..(256): n is a, c, g, or t
  modified_base (329)..(329): a, c, t, g, unknown or other
  misc_feature (329)..(329): n is a, c, g, or t
  modified_base (346)..(346): a, c, t, g, unknown or other
  misc_feature (346)..(346): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggccccaggacagaaggtcaccatctcctgctctggaagcagcctaccaaactagttaggggaataatttttggngttcctggtaccagcagctaccaggaacacgacccccaaactcctctattttgaacaataataacgcaccctnaggtacttctgaccgtnttctctgctcccagtctgcacgtcacgccaccgtggccatccgaccggactccgagacgtcggggaacgacggaccgtagttacttacgtaggacgaaactagtgggaatagcgaacgtccgtagaacggtacctggtagaattaaacgcgggacggaacggggaacccaaaaggtccgtacggtaacccggttccgttaaaggaccgaccggacccgaaaggcccgtaaccggccccccgttacggttaccaaccgtttcccgtaccggtttaccccctaacccccg

SEQ ID NO: 350426 - DNA, 577 bp, Homo sapiens
  misc_feature: GZ8MTXP02GXFV7.19.59.F04.1.454.CMB.2.raw
  modified_base (171)..(171): a, c, t, g, unknown or other
  misc_feature (171)..(171): n is a, c, g, or t
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctnagtgtctgccggccccaggacagaaggtcaccatctcctgctcgtggaagcagctaccaaanagttagggaaataattttgngtcctggtaccagcagctccaggaacacgccccaaactcctctattttagacaaataataaacgcgaccctcgaagggacttccctagaccgtattctctcggctacccaagtctggcacgtcagcccaccgtggcactccacgactccagacgtggggacgacggccgtaattactacgtggacggaaacagtgggatacgcgaacgtcctgagtacgtgtagaactaagtcgggacgggaaggaaccaaggctacggaccgtcgtacggcacgaccgaacggcaaccgtcccccgtcgtccacgtcctccgtcccgtccccg

SEQ ID NO: 350427 - DNA, 585 bp, Homo sapiens
  misc_feature: GZ8MTXP02I7SMP.19.59.F04.1.454.CMB.2.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggcccaggacagaaggtcaccatctcctgctctggaagcagctccaanattgggaatatttgngtcctggtaccagcagctcccaggaacagcccccaaactcctcattttgacaataataagcaccctcaggattcctgaccgattctctggctccccaagtctggcacgtcagccacctgggccatcaccggactccagacgtggggacgagggcccgaagttacttacgtgaccgggaaacagtacgggattaggacacggccgtagaggttaactgtagaagtaaagtcgggaggaacgggaaccaaaggcgtacggaccgtccgtaagggtccacggacccgaaaggccgttccggcccccttcgggtcccaaccttccgttccgtccccctaacccccg

SEQ ID NO: 350428 - DNA, 582 bp, Homo sapiens
  misc_feature: GZ8MTXP02H8VIX.19.59.F04.1.454.CMB.2.raw
  modified_base (246)..(246): a, c, t, g, unknown or other
  misc_feature (246)..(246): n is a, c, g, or t
  modified_base (273)..(273): a, c, t, g, unknown or other
  misc_feature (273)..(273): n is a, c, g, or t
  modified_base (320)..(320): a, c, t, g, unknown or other
  misc_feature (320)..(320): n is a, c, g, or t
  modified_base (331)..(331): a, c, t, g, unknown or other
  misc_feature (331)..(331): n is a, c, g, or t
tcagtactctcgtgcacgaccggtgctcgatttagtacacacacttagggattgggggcagaaggcaggactcgggacaatcttcatcatgacctgctcccctctcctcttcacccttctcattcactgcacagggtcctgggcccagtctgtgttgacgcagccgccctcagtgtctgcggccccaggacagaaggtcaccatctcctgctctggaagcagctccaacattgggaataattttgngtcctggtaccagcagctccaggaacngacccccaaactcctctattttgaactaaataataagccgaaccctnagggacttccngaccgattctctggctcccaagtctggcacgtcacgccacccgtggcatccaccggactccagacgtgggacgacggccgattatacgtgacggaacagtaggatagcagtcctgagtactgagaataacgtcgggacggaggaaccgaagtcgtacggacccgtcgtacggtccaacgaccccgaaggccttaaccggccccccgttacggtcctaacccgttccttaccggtttaccccctaacccccg

SEQ ID NO: 350429 - DNA, 523 bp, Homo sapiens
  misc_feature: GZ8MTXP02JHJ6R.19.59.F04.1.454.CMB.2.raw
  modified_base (291)..(291): a, c, t, g, unknown or other
  misc_feature (291)..(291): n is a, c, g, or t
tcagtactctcgtgcacgaccggtgctcgatttagtacacacacttagggattgggggccctagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagcctggagggtccctgagactctcctgtgcagcctctggattcaccttcagtagttatgaaatgaattggtccncaggctccgagggaggggctggagtgggtttcatacattagtagtagtggtagtagcatatactacgcagactctgtgaagggccattcaccatctccagagacagcgaccaagactcactgtatctgacaaatgaacagcctagagagccgaggacacggctaagtttattacgtgtgacgagagagtggacaaggtggaggggtcgacgtagtttggtacggtggttagg

SEQ ID NO: 350430 - DNA, 545 bp, Homo sapiens
  misc_feature: GZ8MTXP02ILC9L.19.59.F04.1.454.CMB.2.raw
  modified_base (395)..(395): a, c, t, g, unknown or other
  misc_feature (395)..(395): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttcctgttgctattttagaggtgtccagtgtgaggtgcagctggtggagtcgtgggggagcttggtacagcctggaggtccctgagactctctgtgcagcctctggattcaccttcagttagttatgaaatgtaattgggtcccgccgaggctccgaaggggaaggggctgggagtgggtttacataccagtttagtagtagtggtaagtagctatatactacgcagacttcngtgaacggggccattccaactatcctacagagacagaccgaccaaagacctcacttgtaatcgtagactaaatgaatcgcctagaacggacgaccggaaggtacaacggtcttaagtttatactggtcgacgagagtggtggactaaggg

SEQ ID NO: 350431 - DNA, 518 bp, Homo sapiens
  misc_feature: GZ8MTXP02IY5EB.19.59.F04.1.454.CMB.2.raw
  modified_base (245)..(245): a, c, t, g, unknown or other
  misc_feature (245)..(245): n is a, c, g, or t
  modified_base (414)..(414): a, c, t, g, unknown or other
  misc_feature (414)..(414): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaatattttgngtcctggtaccagcagctccaggaacagcccccaaactcctcattttgacaataataagcgaccctcagggattcctgaccgattctctggctcccagtctgcacgtcagccaccgtggcatcaccggactccagacgtgggacgaggccgattagtactgcgaacagnggatagcagcctgagtactgtgataagcggcggaggacaagctgaccgtcgtaaggtcagacccgaaggctcgccccctggtccacgtcctcgtcccctacccg

SEQ ID NO: 350432 - DNA, 526 bp, Homo sapiens
  misc_feature: GZ8MTXP02IRXYT.19.59.F04.1.454.CMB.2.raw
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (415)..(415): a, c, t, g, unknown or other
  misc_feature (415)..(415): n is a, c, g, or t
  modified_base (492)..(492): a, c, t, g, unknown or other
  misc_feature (492)..(492): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaanttgggaatatttgngtcctggtaccagcagctcccaggaacagcccccaaactcctcattttgacaataataagcgaccctcagggacttcctgaccgattctctggcctcccaagtctggcacgtcacgccacctgggcatccaccggactccagctggggacaggccgattatacctgcgaacngtgggatagcagcctgagtactgtagataagtcggcggagggacaagctagaccgtcgtaggtcacgcccgaagccncgccccctcggtccacgtcctcgttcccgtcccc

SEQ ID NO: 350433 - DNA, 537 bp, Homo sapiens
  misc_feature: GZ8MTXP02HGEI0.19.59.F04.1.454.CMB.2.raw
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
  modified_base (439)..(439): a, c, t, g, unknown or other
  misc_feature (439)..(439): n is a, c, g, or t
tcagtactctcgtgcacgaccggtgctcgatttagtacacacacttagggattggggcagaaggcaggactcgggacaatcttcatcatgacctgctcccctctcctcctcacccttctcattcactgcacagggtcctgggcccagtctgtgttgacgcagccgccctcagtgtctgcggcccaggacagaaggtcaccatctcctgctctggaancagctcaanttgggaanattttgngtcctggtaccagcagctcccaggacagcccccaaactcctcattttgacaataataagcgaaccctcagggattcctgaccgattctctggctccccaagtctggcacgtcagccacctggcatcacggactccagactgggacgaggccgattattactgacggaacagtcgggaatagcaagtcctgagttaacngtagataagtcggacggagggaccaaagcgtacgaccgtcctaggtacacgccccgaaggctcgacccccgtcggtcacctcctcgtttccccgcccc

SEQ ID NO: 350434 - DNA, 601 bp, Homo sapiens
  misc_feature: GZ8MTXP02HUQN1.19.59.F04.1.454.CMB.2.raw
  modified_base (231)..(231): a, c, t, g, unknown or other
  misc_feature (231)..(231): n is a, c, g, or t
  modified_base (248)..(248): a, c, t, g, unknown or other
  misc_feature (248)..(248): n is a, c, g, or t
  modified_base (318)..(318): a, c, t, g, unknown or other
  misc_feature (318)..(318): n is a, c, g, or t
  modified_base (454)..(454): a, c, t, g, unknown or other
  misc_feature (454)..(454): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggccccaggacagaaggtcaccatctcctgctctggaagcagctaccaanagttgggaatattttgngtcctggtaccagcagctccaggaacacgcccccaaactcctctattttgacaaataataagcgaccctnagggattcctagaccgtattctacgtggcctcccaagtcctgacacgtccagcccaacccgtggccactccgaccggactcccgagacgtcggggacgaggcccgaattattacgtgacggaacagtgggaatagnacgcctagagtactggtagaataagtcgggacggaacgggaccaaaaggcgtacggaccggtactacgggtacacggacccgaaggccgtaaccggtcccccgtacgggtaccaccgttccgttaccggtttaccccctaacccccg

SEQ ID NO: 350435 - DNA, 567 bp, Homo sapiens
  misc_feature: GZ8MTXP02G3NWE.19.59.F04.1.454.CMB.2.raw
  modified_base (430)..(430): a, c, t, g, unknown or other
  misc_feature (430)..(430): n is a, c, g, or t
tcagtactctcgtgcacgaccggtgctcgatttagtacacacacttagggattgggggccctagccctggattccaaggcatttccacttggtgatcagcactgaacacagaggactcaccatggagttggggctgtgctgggttttcctgttgctattttagaaggtgtccagtgtgaggtgcagctggtggagtcgtgggggaggcttggtacagcctgggagggtccctgagactctcctgtgcagcctctggattcaccttcagtagttatagaaatgaattggtccgccgaggcctccgaggggaaggggctggagttggttcatacattagtagtagtgtagtagcatatactacgcagactcgtgtagaagggccgtattccactatctaccagacgacagcgaccgaaagacctcactgtancgtagacaaaatcgaaacagacctaggaacgacggacccggaaggaccgacgggactaagtttaactacgtggtacgacgaggagacggtggactaaaggtggaaggggtacggactagttggtaaggtgggttagg

SEQ ID NO: 350436 - DNA, 738 bp, Homo sapiens
  misc_feature: GZ8MTXP02IF76P.19.59.F04.1.454.CMB.2.raw
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaanattgggaataattttgngtcctggtaccagcagctaccaggaacacgacccccaaactcctactattttacgacaaataactaacgacgaccctacgaagggtactttcccgtagtaccgtattcctactcggtacctaccccgtaacgttcctcggactacgtccgaccgcccgtaccccgttcggggccctaacgttccccgaacccgggtacctacccgaaacgtacccggtacgggggaccgacgggacccggtaagtttacgttaaccgtggaaccgggaaacgtacgtaggggaacttacggacgtacggaccgttaggtaacgttacgtaggtagtaaagtaacgtccggggacgggaacggggaaccgaaacggtccgttacggacccggttaccgttaacgggtaccgaaccggaccccgtaaacggcccgtaacccgtacccccgtaccgggtaccctaacccgtttccccgttacccggtttccccccggtacccccg

SEQ ID NO: 350437 - DNA, 540 bp, Homo sapiens
  misc_feature: GZ8MTXP02FREXU.19.59.F04.1.454.CMB.2.raw
  modified_base (230)..(230): a, c, t, g, unknown or other
  misc_feature (230)..(230): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (257)..(257): a, c, t, g, unknown or other
  misc_feature (257)..(257): n is a, c, g, or t
  modified_base (312)..(312): a, c, t, g, unknown or other
  misc_feature (312)..(312): n is a, c, g, or t
  modified_base (348)..(348): a, c, t, g, unknown or other
  misc_feature (348)..(348): n is a, c, g, or t
  modified_base (413)..(413): a, c, t, g, unknown or other
  misc_feature (413)..(413): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacnttgggaanattttgngtcctggtaccngcagctcccaggaacagcccccaaatcctcattttgacaataataagcgaccctnaggattcctgaccgtattctctggctccccaagtcnggcacgtcagccacctggcatcacggactccagactggggacgagcccgattactactgcggaanacgtgggatagcagcctgagtactgagagtaagtcggacggagggacaagcgtagaccggtactaggtccagacccaaggcctaacgtcccccgtacggtacaccgttccgtcgtttcccctaaccg

SEQ ID NO: 350438 - DNA, 737 bp, Homo sapiens
  misc_feature: GZ8MTXP02IQE0V.19.59.F04.1.454.CMB.2.raw
  modified_base (249)..(249): a, c, t, g, unknown or other
  misc_feature (249)..(249): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctaccaacagttagggaataattttgngtcctggtacagcagctccaggaacacgccccaaactcctctattttgactaaataataacgcgaaccctcaagggtactttccctacgtaccgatttcctactcggcctaccccgaagtctcggctacgtccacgcccgtaccctcgggccacgtccgaccggacctccacgaccgtagggggaacgacgggacccgtaagttaacgttaccgtggaacggaaaccgagttacggggaattacggaccgtaacggtcccgttagtaacggttaaccgtagggtaggaaagtttaaacggtccgggggaaccggggaacggggaaacccgaaacggtaccggtacgggaaaccccggtttacccgtaaacgggttaccgaaaccggtacccccgaaaaggggtccccttaacccgggtacccccccgttccggggttacccctaacccggttcccgtttacccggttttacccccccgtaccccccgg

SEQ ID NO: 350439 - DNA, 913 bp, Homo sapiens
  misc_feature: GZ8MTXP02I10J3.19.59.F04.1.454.CMB.2.raw
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggccccaggacagaaggtcaccatctcctgctctggaancagctccaanattggaatatttgngtcctggtacagcagctccaggacacgacccccaaactcctactactttttgaactaaattaaataacgacgaacccctcgaacggggtactttacccgtcgtaaccggtaactttccttccgttacgggtccttacccccgtaaaacggttccgtttcgggacctaaccggtttaccgaacggcccccgaaaccccgtttcgggggacctaccgttacccgaaccccgggggtaaccttccccgaaacggacccggttaggggggacccggtaaacggggaccccgtaagttttaacgtttaacccgttacggtacccggggaaaacccgtagggtaccgggggtaaaagtttaccgggaacccgtaacggggttacccccgttagggtaaccgggtttaaacccgtttaacgggttacggtaaaaggttaaaaccggtttcccggggggtaccggggtaaaacgggggtaaacccccggaaaaacggtccggtttaaacccgggtaaaccccggggtttcccggttaaaacgggggtttacccgtaaaccgggaaaccccccggtaaaacggggtccccggttaacccggtaccccccccggttccgggggttaacccctaaacccggtttcccgtttacccgggtttacccccgttttaacccccg

SEQ ID NO: 350440 - DNA, 522 bp, Homo sapiens
  misc_feature: GZ8MTXP02GJMCU.19.59.F04.1.454.CMB.2.raw
  modified_base (246)..(246): a, c, t, g, unknown or other
  misc_feature (246)..(246): n is a, c, g, or t
  modified_base (286)..(286): a, c, t, g, unknown or other
  misc_feature (286)..(286): n is a, c, g, or t
  modified_base (311)..(311): a, c, t, g, unknown or other
  misc_feature (311)..(311): n is a, c, g, or t
  modified_base (333)..(333): a, c, t, g, unknown or other
  misc_feature (333)..(333): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggccccaggacagaaggtcaccatctcctgctctggaagcagctccaacattgggaatattttgngtcctggtaccagcagctccaggaacagccccaaatcctnattttgacaataataagcgaccctnagggatttcctgaccgattctntggctccccaagtctggcacgtcagccacctgggcactcaccggactccagactggggacaggccgatttactactgcggtaaacagtgggatagcagcctgagtactgagattaagcggagagggaccaagctcgaccgtctaggcacgccgaaggctcgcccctcggcaccgtctcgtccccgtccc

SEQ ID NO: 350441 - DNA, 525 bp, Homo sapiens
  misc_feature: GZ8MTXP02FVQ5C.19.59.F04.1.454.CMB.2.raw
  modified_base (273)..(273): a, c, t, g, unknown or other
  misc_feature (273)..(273): n is a, c, g, or t
  modified_base (290)..(290): a, c, t, g, unknown or other
  misc_feature (290)..(290): n is a, c, g, or t
  modified_base (366)..(366): a, c, t, g, unknown or other
  misc_feature (366)..(366): n is a, c, g, or t
  modified_base (369)..(369): a, c, t, g, unknown or other
  misc_feature (369)..(369): n is a, c, g, or t
tcagtactctcgtgcacgaccggtgctcgatttagtacacacacttagggattgggggccctagccctggattccaaggcatttccacttggtgatcagcactgaacacagaggactcaccatggagttgggctgtgctgggttttcctgttgctattttagaaggtgtccagtgtgaggtgcagctggtggagtcgtgggggaggcttggtacagcctggagggtccctgagactctcctgtgcagcctctggattcaccttcagtagttangaaatgaattgggtccnccaggctccgaggggaggggctggagtggtttcagtacattagtagtagtggtagtagcatatactacgcagactntgngaagggccattcacatcctcagagacagcgaccaaagactcactgtactctagacaaatgaaacagcctagagacgaccgaggacacggctaagtttactactgtgcgagagaggtgacgaaggtggaggggtcggactagttggtaggtggtagg

SEQ ID NO: 350442 - DNA, 702 bp, Homo sapiens
  misc_feature: GZ8MTXP02JUNEV.19.59.F04.1.454.CMB.2.raw
  modified_base (217)..(217): a, c, t, g, unknown or other
  misc_feature (217)..(217): n is a, c, g, or t
  modified_base (244)..(244): a, c, t, g, unknown or other
  misc_feature (244)..(244): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggcccaggacagaaggtcacatctcctgctctggaancagctacaacagttgggaatattttgngtcctggtacagcagctccagaacacgaccccaaactcctactattttgaactaaataactaagccgaaccctacgaagggtacttccgtacgaaccgtacttctccgtggtcctaccccgtaagtcctacggacctacggtaccacggtccccctaacccgttggggacctacgttacccgaacccggtacctacccgaacgtaacccggttacgggggaacgacgggtacccgtaagtttaacgttaccgtacggtaccggaaacgtagtacggggaatacggaccgtagacccgtaggtacgtaacgtgtaagtaagttaacggtcgggacgggaacggaccgaaggtaccgtacggtacccgtacgggtacggtaaccgacgtaccccggaacggtacccgtccggtcccccgttcggtacctacgttcccgttcccgtaccccggttcccccg

SEQ ID NO: 350443 - DNA, 555 bp, Homo sapiens
  misc_feature: GZ8MTXP02GO5CM.19.59.F04.1.454.CMB.2.raw
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (288)..(288): a, c, t, g, unknown or other
  misc_feature (288)..(288): n is a, c, g, or t
  modified_base (304)..(304): a, c, t, g, unknown or other
  misc_feature (304)..(304): n is a, c, g, or t
  modified_base (439)..(439): a, c, t, g, unknown or other
  misc_feature (439)..(439): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggtttcctgtgctattttagaggtgtccagtgtgaggtgcagctggtggagtcgtgggggaggcttggtacaggcctgggaggtccctgagactctcctgtgcagcctntggattcaccttnagtattangaaatgaattgggccncaggctcgagggagggctggagtggttcatacattagtagtagtggtagtagcatatactacgcagactctgtggaaacggggcctaattccaccattcctaccagagacagccgaccaaagactgactgtaacnctagacaaagtcgaaccagccctaggaacgacggacccggtaaggacccaacggggtacctaaggtttttaacttacggtaagtcggacgaaggaggtaagtggggactaaagggg

SEQ ID NO: 350444 - DNA, 501 bp, Homo sapiens
  misc_feature: GZ8MTXP02I4DNC.19.59.F04.1.454.CMB.2.raw
  modified_base (292)..(292): a, c, t, g, unknown or other
  misc_feature (292)..(292): n is a, c, g, or t
  modified_base (435)..(435): a, c, t, g, unknown or other
  misc_feature (435)..(435): n is a, c, g, or t
  modified_base (446)..(446): a, c, t, g, unknown or other
  misc_feature (446)..(446): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggtttccttgttgctattttagaaggtgtccagtgtgaggtgcagctgggtggagtcgtgggggagcttggtacagcctgggagggtccctgagactctcctgtgcagcctctggattcaccttcagtagttangaaatgaattgggccgccaggctccgaggggagggctggagtgggttcatacattagtagtagtggtagtagcatatactacgcagactctgtgaaggccattcaccatcctacagacgacagcgacaaagactcactgatcngacaatgaacngctgacgagaccgagacacggctagtttatacgtgtgcgagagaggtggacaagg

SEQ ID NO: 350445 - DNA, 633 bp, Homo sapiens
  misc_feature: GZ8MTXP02JUX3K.19.59.F04.1.454.CMB.2.raw
  modified_base (534)..(534): a, c, t, g, unknown or other
  misc_feature (534)..(534): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctatttagaaggtgtccagtgtgaggtgcagtcgtgggtggagtcggtgggggaggtcgttggtacaggtccgtgggacggtccctggacgactctcctgtgcacgcctcgtggtacttccaccttcagttagttatagtaaagtgtaagtttcgggtcccgcgtaacggccgtccggaaggggacggggcgtagggtaggttgggttcaagtacccgtagttagtagttaggtaggtagtagctaagttactacgtacgacaagtacctcgtggtaaggaacggggcctaattccaaccgtatcctacgaggacacgagccgaactaaagacctcagtgtaactcagtaacaaagtcgaancgtaccgaggacgaaccggcccggaaaggaccgtacgggtacttaacggttttactacggtggacgggacgtaaggtaaggaggtacggaaacgtgggg

SEQ ID NO: 350446 - DNA, 522 bp, Homo sapiens
  misc_feature: GZ8MTXP02F0HII.19.59.F04.1.454.CMB.2.raw
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (511)..(511): a, c, t, g, unknown or other
  misc_feature (511)..(511): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaancagctccaaanttgggaanattttgngtcctggtaccagcagctcccaggaacagcccccaaactcctcattttgacaataataagcgaccctcagggattcctgaccgattctctggctcccaagtctgcacgtcagccaccctgggcatccaccggactcccagacgtggggacgaggcccgaattatactgcgaaacagtgggatagctagcctgacgtaactgtgataagtcgggcggagggaccaagctgaccgtcaggtcacgcccaagctcgcccctgtcactcncgtcccgtccc

SEQ ID NO: 350447 - DNA, 521 bp, Homo sapiens
  misc_feature: GZ8MTXP02JOCJN.19.59.F04.1.454.CMB.2.raw
  modified_base (230)..(230): a, c, t, g, unknown or other
  misc_feature (230)..(230): n is a, c, g, or t
  modified_base (238)..(238): a, c, t, g, unknown or other
  misc_feature (238)..(238): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacnttgggaanaattttggtcctggtaccagcagctcccaggacagcccccaaactcctcattttgacaataataagcgaccctcagggattcctgaccgattctctgctcccaagtctggcacgtcagccacctggcatcaccggactccagactggggacgaggccgattatactgcgaacagtgggatagcagcctgagtactgtagataagtcggacggaggacaagctgaccgtcgtaggtcacgacccaaggctcgcccccgtcggtcacgtcctcgttccccacccc

SEQ ID NO: 350448 - DNA, 527 bp, Homo sapiens
  misc_feature: GZ8MTXP02JH8XJ.19.59.F04.1.454.CMB.2.raw
  modified_base (265)..(265): a, c, t, g, unknown or other
  misc_feature (265)..(265): n is a, c, g, or t
  modified_base (289)..(289): a, c, t, g, unknown or other
  misc_feature (289)..(289): n is a, c, g, or t
tcagtactctcgtgcacgaccggtgctcgatttagtacacacacttagggattgggggccctagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcttggtacagcctggagggtccctgagactctcctgtgcagcctctggattcaccttnagtagttatgaaatgaattggccncaggctcgagggagggctggagtggttcatacattagagtagtggtagtagcatatactacgcagactctgtggaagggcctattccaccatctaccagagacagcgaccaaagacctcactgtactctagactaaatcgaaactgccgagacgacgaccggaggacacggactagtttatactgtagcgagtagagtcggagaggtggaggggtcgatagttggtaggtggttacgg

SEQ ID NO: 350449 - DNA, 557 bp, Homo sapiens
  misc_feature: GZ8MTXP02FSZPQ.19.59.F04.1.454.CMB.2.raw
  modified_base (248)..(248): a, c, t, g, unknown or other
  misc_feature (248)..(248): n is a, c, g, or t
  modified_base (316)..(316): a, c, t, g, unknown or other
  misc_feature (316)..(316): n is a, c, g, or t
  modified_base (325)..(325): a, c, t, g, unknown or other
  misc_feature (325)..(325): n is a, c, g, or t
  modified_base (336)..(336): a, c, t, g, unknown or other
  misc_feature (336)..(336): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggccccaggacagaaggtcaccatctcctgctctggaagcagctccaaacattgggaaatattttgngtcctggtaccagcagctccaggaacacgcccccaaactcctcattttgacaataataagcgaccctnaggattccngaccgtattcntggctcccaagtctggcacgtcacgccaccgtggcatccaccggactccagacgtggggacaggccgattactacgtgacggaacagtgggatagcacgcctagagtactgtgaattaacgtcgggacggaacggaccaagctcgacccgtacgtaggtcacgacccgaaggcctaaccggtccccctacggtcctacgttcctcggttacccctaccccg

SEQ ID NO: 350450 - DNA, 539 bp, Homo sapiens
  misc_feature: GZ8MTXP02GI8TX.19.59.F04.1.454.CMB.2.raw
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
  modified_base (245)..(245): a, c, t, g, unknown or other
  misc_feature (245)..(245): n is a, c, g, or t
  modified_base (313)..(313): a, c, t, g, unknown or other
  misc_feature (313)..(313): n is a, c, g, or t
  modified_base (454)..(454): a, c, t, g, unknown or other
  misc_feature (454)..(454): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaancagctccaanattgggaatattttgngtcctggtaccagcagctcccaggaacagcccccaaactcctcattttgacaataataagcgaccctnagggattcctgaccgattctctggctcccagtctggcacgtcagccacctggcatcaccggactcccagacgtggggacgaggccgattacgtactgacggaacagtggaatagcagcctgagtacgtgtagatagtcggngagggacaagtctcggaccgtcgtacggtcacgacccgaaggcctaacggccccctggtacctacgtcctcggtcccctaccccg

SEQ ID NO: 350451 - DNA, 529 bp, Homo sapiens
  misc_feature: GZ8MTXP02GNO8O.19.59.F04.1.454.CMB.2.raw
  modified_base (310)..(310): a, c, t, g, unknown or other
  misc_feature (310)..(310): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctgggtggagtcgtggggggagcttggtacagcctgggagggtccctgagactctcctgtgcagcctctggattcaccttcagtagttatgaaatgaattggtccnccaggctccgaggggagggctggagtgggttcataccattagtagtagtggtagtagcatatactacgcagactctgtgaaaggccattcaccatctcagagacagcgaccaaagaactcactgtaatctagactaaaatcgaaacagcctagaacgacgaccgaagggacacgggctaaggttttactacgtgtgacggagaggaggtggacaaaggg

SEQ ID NO: 350452 - DNA, 562 bp, Homo sapiens
  misc_feature: GZ8MTXP02JCPI0.19.59.F04.1.454.CMB.2.raw
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (313)..(313): a, c, t, g, unknown or other
  misc_feature (313)..(313): n is a, c, g, or t
  modified_base (352)..(352): a, c, t, g, unknown or other
  misc_feature (352)..(352): n is a, c, g, or t
  modified_base (452)..(452): a, c, t, g, unknown or other
  misc_feature (452)..(452): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaancagctccaanttgggaatattttgngtcctggtaccagcagctcccaggacacgcccccaaactcctctattttgacaataataagcgaccctnaggacttcctgaccgtattctctggctcccaagtctgcncgtcagcccacccgtgggccagtccaccggactccgagacgtggggacgaggcccgtaattactacgtgacggaacagtggaatagcagcctagagtacngtgatagtcggacggaggacaagcgtacgaccgtcgtaggtccacgtacccgaaggcctaacccgtcccccgtacggtcctaccgtccgttccggttcccccgtcccccg

SEQ ID NO: 350453 - DNA, 523 bp, Homo sapiens
  misc_feature: GZ8MTXP02GNTWB.19.59.F04.1.454.CMB.2.raw
  modified_base (245)..(245): a, c, t, g, unknown or other
  misc_feature (245)..(245): n is a, c, g, or t
  modified_base (462)..(462): a, c, t, g, unknown or other
  misc_feature (462)..(462): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaatattttgngtcctggtaccagcagctcccaggacagccccaaactcctcattttgacaataataagcgaccctcagggattccctgaccgtattctctggctcccaagtctggcacgtcagccacctgggcatcaccggactccagacgtggggacgaggccgattatactgacgtaacatgggatagcagctgagtactgtgactagtcggcggaggacaagcngaccgtctaggtcacgccaaggctcgacccccgtcggtccacgtctcgttcccctaccccg

SEQ ID NO: 350454 - DNA, 612 bp, Homo sapiens
  misc_feature: GZ8MTXP02FNZY4.19.59.F04.1.454.CMB.2.raw
  modified_base (271)..(271): a, c, t, g, unknown or other
  misc_feature (271)..(271): n is a, c, g, or t
  modified_base (293)..(293): a, c, t, g, unknown or other
  misc_feature (293)..(293): n is a, c, g, or t
  modified_base (309)..(309): a, c, t, g, unknown or other
  misc_feature (309)..(309): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctgggtggagtcgtgggggagcttggtacagcctgggagggtccctgagactctcctgtgcagcctntggattcaccttcagtagttangaaatgaattggtccncaggctcgaggggagggctggagtggtttacataccattagagtagtggtagtagcatatactacgcagactcgtagtagaaacggggtctaattccaaccctatcccgtaccaaggacgaaccaggaccgacccaaaagtaacctcaaccttaggtaatccgtagaacaaaacttcggaaaacctacgaccgtaaggaacggtacggaccgggaaacggtaccgaacgggtacttaaaggttttacttacggtaaggtacggaacggtaaggtaaggtaacgggtacgggaacgtaaagggg

SEQ ID NO: 350455 - DNA, 560 bp, Homo sapiens
  misc_feature: GZ8MTXP02FRPV8.19.59.F04.1.454.CMB.2.raw
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaancagctccaacattgggaanattttgngtcctggtaccagcagctcccaggaacagcccccaaactcctcatttttgacaataataagcgaccctcagggattccctgaccgattctctggctcccaagtctggcacgtcagccacctggcatcacggactcagctggggacgagccgattatactgcgaacatgggatagcagcctgagtactgtgataagtcggcggaagggaccgaaagcgttacgaccggtacctaacgggttcgacgaccccgaaagggccttccggccccccgttcggggtccctaaccttccgttccggtttccccccgtccccg

SEQ ID NO: 350456 - DNA, 528 bp, Homo sapiens
  misc_feature: GZ8MTXP02JYGBK.19.59.F04.1.454.CMB.2.raw
  modified_base (289)..(289): a, c, t, g, unknown or other
  misc_feature (289)..(289): n is a, c, g, or t
  modified_base (316)..(316): a, c, t, g, unknown or other
  misc_feature (316)..(316): n is a, c, g, or t
  modified_base (477)..(477): a, c, t, g, unknown or other
  misc_feature (477)..(477): n is a, c, g, or t
  modified_base (511)..(511): a, c, t, g, unknown or other
  misc_feature (511)..(511): n is a, c, g, or t
  modified_base (522)..(522): a, c, t, g, unknown or other
  misc_feature (522)..(522): n is a, c, g, or t
  modified_base (525)..(525): a, c, t, g, unknown or other
  misc_feature (525)..(525): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaggtgtccagtgtgaggtgcagctgggtggagtcgtggggggaggcttgggtacagccgtgggacgggtccctggagactctcctgtgcagcctctggattcaccttnagttagttatgaaatgaagttgggccncaggctcgaggggagggctggagtggttcataccattagtagtagtggtagtagctaatatactagcagactcgtgtaggaaacggggcccattccaacccgtatcctaccaagacgacacgccgaccaaagacctcactgtatcgtagacaaatgaaacngcagacgacgcgagacacgactagttatacgtgngacgagagagnganagg

SEQ ID NO: 350457 - DNA, 607 bp, Homo sapiens
  misc_feature: GZ8MTXP02G4U8V.19.59.F04.1.454.CMB.2.raw
  modified_base (171)..(171): a, c, t, g, unknown or other
  misc_feature (171)..(171): n is a, c, g, or t
  modified_base (247)..(247): a, c, t, g, unknown or other
  misc_feature (247)..(247): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctnagtgtctgcggcccaggacagaaggtcaccatctcctgctctggaagcagctaccaaacagttgggaatattttgngtcctggtaccagcagctccaggaacacgacccccaaactcctactattttagactaaataaataaacgaccgaaccctacgacgggtactttcccgtagaccgtattctctggctccccaagtctgcacgtcacgccaccgtggcactccaccggctccgagacgtgggacgaggccgattatactgacggtaacagtggatagacgagtccgtgacgtacgtagtagaagtagtcgggacggaacgggaccgaaggtacgtacggaacccgttccgtaacgggtaccgaacgacccgaaacggtaccctccggtacccccgtcgggtaccaccgttccgtccgttaccccctcccccg

SEQ ID NO: 350458 - DNA, 760 bp, Homo sapiens
  misc_feature: GZ8MTXP02IFJ5U.19.59.F04.1.454.CMB.2.raw
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaancagctcaanttgggaatatttgtgtcctggtaccagcagctccaggaacacgacccccaaactcctctattttcgaactaaataataagaccgtaccctcgaagggtactttcccgtcgtaaccgtatttcctacgtcggtcctccccgtaaacgtccgttcggcctaacggttccaacgtccccgaaccccgttgggggcctaaacgttcccgaacccgggactcccgaacgaccggtacgggggaaccgacgggtacccgtaatttacgttacgtacggaacggtaaaccgtagttaggggaaattacggaccgtaacggtacccgttaggtaacggttaccgttaggtaagtacgttaaacgggtccggggacggggaaacggggacccgaaaacggtccggtacggtacccggttaccgtttaaacgggggtacctaaccggacccccgtaaacgggtccccgtaacccgggtacccccccgttcggggttaccccaacccgttttccccggtccgttttacccccccggtcccccg

SEQ ID NO: 350459 - DNA, 545 bp, Homo sapiens
  misc_feature: GZ8MTXP02JDWG2.19.59.F04.1.454.CMB.2.raw
  modified_base (295)..(295): a, c, t, g, unknown or other
  misc_feature (295)..(295): n is a, c, g, or t
  modified_base (314)..(314): a, c, t, g, unknown or other
  misc_feature (314)..(314): n is a, c, g, or t
  modified_base (389)..(389): a, c, t, g, unknown or other
  misc_feature (389)..(389): n is a, c, g, or t
  modified_base (458)..(458): a, c, t, g, unknown or other
  misc_feature (458)..(458): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcttggtacagcctgggacgggtccctgagactctcctgtgcagcctctggattccaccttcagttagttanagaaatgaatttgggcccncaggctccgaggggagggctgggagtggttcatacattagtagtagtggtagtgcatatactacgcagactgtgngaaggccattcacctatcctcgagagacagacgaccaaagactcactgtaactctagacaaatgaaacngcctaggacgacggaccggaggaaccacggtacttaaggtttactaacgtggtcgacggacggaggtacggtacggacgtaaagggg

SEQ ID NO: 350460 - DNA, 695 bp, Homo sapiens
  misc_feature: GZ8MTXP02GO70Q.19.59.F04.1.454.CMB.2.raw
  modified_base (249)..(249): a, c, t, g, unknown or other
  misc_feature (249)..(249): n is a, c, g, or t
tcagtactctcgtgcacgaccggtgctcgatttagtacacacacttagggattgggggcagaaggcaggactcgggacaatcttcatcatgacctgctcccctctcctcctcaccattctcattcactgcacagggtcctgggcccagtctgtgttgacgcagcccgcctcagtgtctgccggcccaggacagaaggtcaccatctcctgctctggaagcagctaccaactagttagggaatattttgngtctggtaccagcagctccaggaacacgaccccaaactcctactattttagaactaaataataacgaccgtaaccctcgaacgggtacttccgtacgtaacccgtatttcctcgtcggtcccctaccgtaagtccgttcgggacctaccggttaccgacgtacccccaaccccggttcgggggaccctaacgttacccgaacccgggtaccttacccgaacggtaccggtacgggggaaccggacgggtacccgtaagtttaacgttacgtacggtaaccgggaaacgtacggtaggggtaataacggacgacggtacccgtagggtacgttacgtagtagtaagtaacggtcgggacgggaacgggaaccagacgtcgaccgtcgacgtcgaccgacgtacggcgtccgaccccgtcgtaccgtacgtccgtaccgttacccccg

SEQ ID NO: 350461 - DNA, 520 bp, Homo sapiens
  misc_feature: GZ8MTXP02IRUZG.19.59.F04.1.454.CMB.2.raw
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
  modified_base (447)..(447): a, c, t, g, unknown or other
  misc_feature (447)..(447): n is a, c, g, or t
  modified_base (484)..(484): a, c, t, g, unknown or other
  misc_feature (484)..(484): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgcctcagtgtctgcgcccaggacagaaggtcaccatctcctgctctggaancagctccaanattgggaatattttgngtcctggtaccagcagctcccaggacacgccccaaactcctctattttgacaataataagcgaccctcaggattccctgacgattctctgctcccaagtctgcacgtcacgccacctgggcactccaccggactcccacgacgtcgggggacgacggccgtaattacttaccgtgacggaacagtggataggcagcctgagtacngtgatagtcggcggaggacaagcgtagacgctacgcncgaccgagctcgccccgtgtcactctacgtccaccc

SEQ ID NO: 350462 - DNA, 720 bp, Homo sapiens
  misc_feature: GZ8MTXP02JH4C8.19.59.F04.1.454.CMB.2.raw
  modified_base (245)..(245): a, c, t, g, unknown or other
  misc_feature (245)..(245): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaagtcaccatctcctgctctggaagcagctccaacagttgggaatattttgngtcctggtaccagcagctcccaggacacgcccccaaactcctctattttgaacaataataagccgaccctcgagggattccctagaccgtattctctggctcccagtctgcacgtcacgccacccgtgggcctactccgaccggtactcccgagaccgtagggggaccgacgggcccgtaagtttacgttaccgtacggacggtaaacgtagttacggggaattacggacgtacggtacccgttaggtacggttaccgtaggttaggtaacgtttaaacggtccgggggtaaccggggaacgggggaaacccaaacgggtaccgttacgggtaaccccggttacccggtaacggggttacccgaaacccgggtacccccgaaacgggtaccccgttaacccggtcccccccggttaccggggttaccctaacccgtttacccgttaccccggtttccccccttaaacccccccgg

SEQ ID NO: 350463 - DNA, 571 bp, Homo sapiens
  misc_feature: GZ8MTXP02H2AOU.19.59.F04.1.454.CMB.2.raw
  modified_base (395)..(395): a, c, t, g, unknown or other
  misc_feature (395)..(395): n is a, c, g, or t
  modified_base (455)..(455): a, c, t, g, unknown or other
  misc_feature (455)..(455): n is a, c, g, or t
  modified_base (488)..(488): a, c, t, g, unknown or other
  misc_feature (488)..(488): n is a, c, g, or t
  modified_base (494)..(494): a, c, t, g, unknown or other
  misc_feature (494)..(494): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctggtggagtcgtggggggaggctttggtacagccgtgggacgggtccctgagactcctcctgtgcagcctctggacttcaccttcagttagtataggaaatgtaagttgggtcccgcgaggctaccggaggggaggggtcgtagggagttgggttacagttaccagtttaagtagtaggtggtagtacgnaattatactacgcagacttcagtaggaacgggcctattcccaactatccacagaagaccngaccgtacaaagaactcaactgtaactcgaaanaacaanaagaacgacgacgacgacgacgacggacggacgacgacgtacgttattacgtaagtagacgagaggaggaggagagg

SEQ ID NO: 350464 - DNA, 651 bp, Homo sapiens
  misc_feature: GZ8MTXP02FZDZG.19.59.F04.1.454.CMB.2.raw
  modified_base (171)..(171): a, c, t, g, unknown or other
  misc_feature (171)..(171): n is a, c, g, or t
  modified_base (231)..(231): a, c, t, g, unknown or other
  misc_feature (231)..(231): n is a, c, g, or t
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctnagtgtctgccggcccaggacagaaggtcaccatctcctgctctggaagcagctaccaaanagttgggaatattttgngtcctggtaccngcagctccagacagcccccaaactcctctattttgaacaataataagacgaccctagagggtattccgtagaccgtatttcctctggcctaccctaagtcgtgcacgtcacgccacccgtgggcactccgaccgactccgacgacgtcggggacgacggccgtattactacgtgacggaacagtgggaatacgacgaacggcccttaggacgtaccgtagtagaagtaacgtacgggacggaaggggtaaccaaggtaccgtacggaaccccggttacgtacgggttaccgaaaccggaccccgtaaacggtacccgttaacccggccccccggtttacgggtacccctaacccgtttcccgttacccgggtttacccccgttccccccgg

SEQ ID NO: 350465 - DNA, 498 bp, Homo sapiens
  misc_feature: GZ8MTXP02FKIIL.19.59.F04.1.454.CMB.2.raw
  modified_base (307)..(307): a, c, t, g, unknown or other
  misc_feature (307)..(307): n is a, c, g, or t
  modified_base (371)..(371): a, c, t, g, unknown or other
  misc_feature (371)..(371): n is a, c, g, or t
  modified_base (402)..(402): a, c, t, g, unknown or other
  misc_feature (402)..(402): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (476)..(476): a, c, t, g, unknown or other
  misc_feature (476)..(476): n is a, c, g, or t
  modified_base (494)..(494): a, c, t, g, unknown or other
  misc_feature (494)..(494): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagcctgggaggtccctgagactctcctgtgcagcctctggattcaccttcagtagttatgaaatgaattggccncaggctccagggagggctggagtggttcataccattagagtagtggtagtagcatatactacgnagactctgtgaagggccattcacatctcagngacngcncaaagactcactgatctgacaaatgaacagcctagacgacgccgaaggacacggctagtttatacgngtgacgagagagtcgganaagg

SEQ ID NO: 350466 - DNA, 680 bp, Homo sapiens
  misc_feature: GZ8MTXP02IEKXB.19.59.F04.1.454.CMB.2.raw
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
  modified_base (316)..(316): a, c, t, g, unknown or other
  misc_feature (316)..(316): n is a, c, g, or t
  modified_base (407)..(407): a, c, t, g, unknown or other
  misc_feature (407)..(407): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggccccaggacaggaaggtcaccatctcctgctctggaagcagctccaanttgggaatatttgngtcctggtaccagcagctccaggacacgcccccaaactcctactattttgactaataataacgcgaccctnacggattccgtagaccgattctactggctccctaagtctgcacgtcacgccacctggccatccaccggactcccgagacgtaggggaccgnggacccgtatttacgtaccgtggaccggaactagtagggactaagccgaagtcccgttaggaacggttactaggtagtaacgttaaaggtccggggacggggtaaacggggaaacccgaaaggtacccgtacgggtaccccgggttaccgtttaaacggggtacccaaaccggggacccccgttaaaggccccggttcccggaacccccccgtttcggggtaccccctaaccgtttccccggtttaccggtttaacccccccgtaaccccccg

SEQ ID NO: 350467 - DNA, 509 bp, Homo sapiens
  misc_feature: GZ8MTXP02FQEV5.19.59.F04.1.454.CMB.2.raw
  modified_base (468)..(468): a, c, t, g, unknown or other
  misc_feature (468)..(468): n is a, c, g, or t
  modified_base (484)..(484): a, c, t, g, unknown or other
  misc_feature (484)..(484): n is a, c, g, or t
  modified_base (496)..(496): a, c, t, g, unknown or other
  misc_feature (496)..(496): n is a, c, g, or t
tcagtactctcgtgcacgaccggtgctcgatttagtacacacacttagggattgggggccctagccctggattccaaggcatttccacttggtgatcagcactgaacacagaggactcaccatggagttggggctgtgctgggttttcctgttgctattttagaaggtgtccagtgtgaggtgcagctggtggagtctgggggaggcttggtacagcctggagggtccctgagactctcctgtgcagcctctggattcaccttcagtagttatgaaatgaattgggtccgccaggctccagggaaggggctggagtgggtttcatacattagtagtagtggtagtagcatatactacgcagactctgtgaaagggccgattcaccatctccagagacagcgcccaaagaactcaactgatctgacaaatgaacagcctgagagccgaggacaggcagtttatactgtncgagagagtggcaagngagggtcggacnttggagtggtagg

SEQ ID NO: 350468 - DNA, 553 bp, Homo sapiens
  misc_feature: GZ8MTXP02IXV3N.19.59.F04.1.454.CMB.2.raw
  modified_base (246)..(246): a, c, t, g, unknown or other
  misc_feature (246)..(246): n is a, c, g, or t
  modified_base (312)..(312): a, c, t, g, unknown or other
  misc_feature (312)..(312): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacagttgggaatattttgngtcctggtaccagcagctccaggacacgcccccaaactcctcattttgacaataatagcgaccctnaggacttcctgaccgtattctctggctcccaagtctgcacgtcacgccaccgtgggcatccaccggactccagacgtggggaacaggcccattactactgacgtaacagtggatagcagcctagagtactgtagattaagcggaggacggacaaggctacggaccgtccgttaaaggccacggacccgaacgtcggtcccgccccgtcggtaccaccttccgttccgtcccccgtcccccg

SEQ ID NO: 350469 - DNA, 644 bp, Homo sapiens
  misc_feature: GZ8MTXP02IR6XH.19.59.F04.1.454.CMB.2.raw
  modified_base (245)..(245): a, c, t, g, unknown or other
  misc_feature (245)..(245): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgcctcagtgtctgcggcccaggacagaaggtcacatctcctgctctggaagcagctaccaacagttagggaatattttgngtcctggtaccagcagctccaggacacgcccccaaactcctactattttagactaaataaataacgacgaaccctacagggactttcccgtacgaccgtacttctctggcctacccgaagtctggcacgtcacgccaccgtcgggcactccgacggacctccagacgtggggacgaggaccgtagttacttactgacggaaacacgtagggactaagcaacgtcgtagacgtaccgttagtacgaaagttacgtacggggacggggaacgggaaccgaaggtacgtacggtacccggttacccgtaaacggggtccgaaccggtaccccggaaacggtccgtaaccggcccccgttacggtacccgtaccgttccgttaccggtttcccccgtcccccg

SEQ ID NO: 350470 - DNA, 567 bp, Homo sapiens
  misc_feature: GZ8MTXP02HJHAB.19.59.F04.1.454.CMB.2.raw
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
  modified_base (311)..(311): a, c, t, g, unknown or other
  misc_feature (311)..(311): n is a, c, g, or t
  modified_base (391)..(391): a, c, t, g, unknown or other
  misc_feature (391)..(391): n is a, c, g, or t
  modified_base (399)..(399): a, c, t, g, unknown or other
  misc_feature (399)..(399): n is a, c, g, or t
  modified_base (455)..(455): a, c, t, g, unknown or other
  misc_feature (455)..(455): n is a, c, g, or t
  modified_base (487)..(487): a, c, t, g, unknown or other
  misc_feature (487)..(487): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttcctgttgctattttagaggtgtccagtgtgaggtgcagctggtggagtcgtgggggagcttggtacagccgtgggacggtccctggagactctcctgtgcagcctgnggattcaccttnagtagttatagaaatgtaagttcggccncgaggcctccggaggggaacggggctgggagttgggttcataccgtattagtagtagtggtagtagctaatatactacgnagacttcngtagaaacgggtccattccaacctatcctacaagacgacagccaaccaaagacttnacttagtaactcgtagactaaaagtgaaaccncgacgagacggacgacgaacgacgacggtacttagtttactagtgtacggacggtaggaggtcggtacggaacgtaaggg

SEQ ID NO: 350471 - DNA, 546 bp, Homo sapiens
  misc_feature: GZ8MTXP02HQPR0.19.59.F04.1.454.CMB.2.raw
  modified_base (319)..(319): a, c, t, g, unknown or other
  misc_feature (319)..(319): n is a, c, g, or t
  modified_base (336)..(336): a, c, t, g, unknown or other
  misc_feature (336)..(336): n is a, c, g, or t
  modified_base (418)..(418): a, c, t, g, unknown or other
  misc_feature (418)..(418): n is a, c, g, or t
  modified_base (435)..(435): a, c, t, g, unknown or other
  misc_feature (435)..(435): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctgggtggagtcgtggggggagtcttggtacaggccgtgggacgggtccctggacgactcctcctgtgcagccctctggactttcaccttcagtagttatagaaatgaatggccncaggctcgagggagggntggagttggttcatacattagtagtagtggtagtgctatatactacgcagactctgtagaaggccattcacatcctacaganacagccgacaaagactnactgatctgacaaaatcgaaacacgctggaacgacggcccggaaaggtaccaccgggtactaaggtttttactacgtggtagacggagaggtacggtacggactaaggggg

SEQ ID NO: 350472 - DNA, 596 bp, Homo sapiens
  misc_feature: GZ8MTXP02JG3SK.19.59.F04.1.454.CMB.2.raw
  modified_base (229)..(229): a, c, t, g, unknown or other
  misc_feature (229)..(229): n is a, c, g, or t
  modified_base (245)..(245): a, c, t, g, unknown or other
  misc_feature (245)..(245): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaanattgggaatattttgngtcctggtaccagcagctcccaggacagccccaaactcctctattttgacaataataagcgaccctgaaggattcctgaccgtattctctggctcccaagtctacggcacgtcacgcccaccgtggcagtcaccggctccgagcgtagggacgacggcccgaattagtactagacggaacacgtgggaatacgcgaacgcctaggaacgtactgtagaataaacggtcgggaccgggaagggaacccaaaggtccgtacggaccggttaccgtaggtaccgacgaccccgaaaggtccgtaaccgcccccgttaccggtactaccgtccgttcccgttaccccggtccccc

SEQ ID NO: 350473 - DNA, 551 bp, Homo sapiens
  misc_feature: GZ8MTXP02FG450.19.59.F04.1.454.CMB.2.raw
  modified_base (397)..(397): a, c, t, g, unknown or other
  misc_feature (397)..(397): n is a, c, g, or t
  modified_base (491)..(491): a, c, t, g, unknown or other
  misc_feature (491)..(491): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctgggtggagtcgtggggggagcttggtacagcctgggagggtccctgagactctcctgtgcagcctcgtggattccaccttcagttagttatgaaatgaagtttcggggtccgccaggcctaccgaggggaaggggctgggagtgggtttacagtaccagttagagtaggtggtagtagcagtatactacgnagactctgtaggaaacggggcctaattccaaccctatcctaccaagacgaacagaccgaccaaagacctcgacttgtatctgacaaatgaaacngcctagacgagccggagacacggctaagtttatacgtgtgacgagagaggtgactaaagg

SEQ ID NO: 350474 - DNA, 746 bp, Homo sapiens
  misc_feature: GZ8MTXP02HBX5R.19.59.F04.1.454.CMB.2.raw
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (251)..(251): a, c, t, g, unknown or other
  misc_feature (251)..(251): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggccccaggacagaaggtcaccatctcctgctctggaancagctccaanttggaatatttgntctgtacngcagctccaggacacgccccaaactcctctattttgactaataataacgcgaccctcgaggtacttcctgaccgtattctctcggtctacccaagtctggcacgtcacgccacccgtggaccactccgaccggactacccgagaccgtcgggggacgacgggacccgtaagtttacgttacgtcggaaccgggtaaaccaggttagggggaaacttacggtaccgaacggtcccgtagggtaacggttaccgttaggttagtaaacggttaaacggtacgggggaaccggggtaaacgggggaacccgtaaaacgggtcccggttaccgggtaaaccccgggtttacccgggttaaacggggttacccgaacccgggttaacccccggaaaacgggtaccccggttaaccccgggtacccccccggttacgggggttaccccttaaccccgggtttacccctttaccccggtttacccccccgttaacccccccg

SEQ ID NO: 350475 - DNA, 869 bp, Homo sapiens
  misc_feature: GZ8MTXP02ISKM1.19.59.F04.1.454.CMB.2.raw
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgcctcagtgtctgccgcccaggacagaaggtcaccatctcctgctctggaacgcagctaccaaactagttagggaataattttggtcgtcccgtaggtacccagcacgcctacccgaggaaccacgacccccaaactcctctattttagaactaaattaaataacgccgtaacccctgaacgggtactttcccgtacgtaacccgtactttcctcgttcggtaccttaccccgtaaacggttccgtacgggtaccctaacgttcccgaaccggtcccccgtaaacccccggtttcgggggaccctaaccgttacccccggaaacccggggtacccttacccgaacgggtacccggtacggggggaaccgaacggggtcccgttaaagtttaacgtttaccgtacggtacccgggaaaagtacggttaggggaaacttaacggaccgtaacgggtccccgttagggtaaacggttaaccgttaggttacgtaaaggttaacggttaccgggggaacgggtaaacgggggaaacccgaaaacggttccggttaccgggtaaaccccgttcccgggttaaacggggtaccaacccgggtaaccccggaaaccggggtcccgtaacccccgggtacccccccgttcggggtttaacccctaccccggtttaccccgtttccccggttaacccccccgttaaccccccg

SEQ ID NO: 350476 - DNA, 614 bp, Homo sapiens
  misc_feature: GZ8MTXP02G460T.19.59.F04.1.454.CMB.2.raw
  modified_base (300)..(300): a, c, t, g, unknown or other
  misc_feature (300)..(300): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaggtgtcagtgtgaggtgcagcgtggtggagtcgtgggggaggtcttggtacagccgttgggacgggtccctgacgctctcctgtgcacgcctctggattccaccttcaagttagttanagtaaatgtaagttggtacccgcgaggtctaccgaagggggagggtctgggagttgggtttacatacctagttagtagtaggtgtagtagctatactactacgcagtactcgtaggtgaaacggggtcctagttaccacctatcccgtacaaggacacaggtccaacctaaagacctacgacttgtaactcctaggacaaaagtcgaaactacgtcctaagggaacgaccgggtaccggaaagtaccggaacggtactttaaagtttccttagtggtacggacggtaaggaggtacgggtaggactaaaggggg

SEQ ID NO: 350477 - DNA, 595 bp, Homo sapiens
  misc_feature: GZ8MTXP02JU8WE.19.59.F04.1.454.CMB.2.raw
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (315)..(315): a, c, t, g, unknown or other
  misc_feature (315)..(315): n is a, c, g, or t
  modified_base (328)..(328): a, c, t, g, unknown or other
  misc_feature (328)..(328): n is a, c, g, or t
  modified_base (563)..(563): a, c, t, g, unknown or other
  misc_feature (563)..(563): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaanttggaatattttgngtcctggtaccagcagctcccaggacacgacccccaaactcctctattttgaactaataataagcgaccctnagggatttcccgngaccgtattcctctggcctcccaagtcgtgcacgtcacgccacccgtgggcactccgaccggacctccgagaccgtagggggaaccgacgggacccgtaagtttaacgttaccgtacggaccgggaaaccgtagttacggggaagtacggacgtacgtaccgtagtacggttacgtgtagaagtaaggtcggacgggacggacgagcgtacgaccgtcgtagcacgacccaggcnccgcccgtcggtcactcctccgtccctacccg

SEQ ID NO: 350478 - DNA, 574 bp, Homo sapiens
  misc_feature: GZ8MTXP02IKWK9.19.59.F04.1.454.CMB.2.raw
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgcttgggttttccttgttgctattttagaaggtgtccagtgtgaggtgcagctggtggagtcgtgggggagtcgttggtacagccgtgggacggtccctgacgactctcctgtgcngcctctgatcaccttnagtatatagaatgtaattggccgccgaggctaccggaggggagggtctagggtagttgggttacatacctagttagtagtaggtaggtagtagctatatacacgcagactcgtgtagaacggtccattccaacctatcctcgaagacgacgacgaccgaccaaagacccttcacgttgtaactcgtagactaaagtcgaaacctgacctaggaacgacgaccggagaaccgacggtcttaagttttactacgtggtacgacggaagaggtcggtacggaacgtaaggg

SEQ ID NO: 350479 - DNA, 618 bp, Homo sapiens
  misc_feature: GZ8MTXP02GXW0T.19.59.F04.1.454.CMB.2.raw
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
  modified_base (292)..(292): a, c, t, g, unknown or other
  misc_feature (292)..(292): n is a, c, g, or t
  modified_base (347)..(347): a, c, t, g, unknown or other
  misc_feature (347)..(347): n is a, c, g, or t
tcagtactctcgtgcacgaccggtgctcgatttagtacacacacttagggattgggggccctagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcttggtacagcctgggacgggtccctggagactctcctgtgcngcctntggattcaccttnagtagttangaaatgaattggccncaggcctcgagggagggctggagttggttcatacatttagtagtagtggtagtgnatatactacgcagtactcgttggtgaaacgggggcctaagttccaaccagttcctacccgaagacgacgacggccgaacccgaaagaaccctactaaccttagtacttcctacggaaccaaaagtacgaaaccgacggtccctaggaacgacggacccggaaggtacgaccggtactaggtttacttaacgtggttacggacgaggaagtacggttaggacgtaaaggtggacgggggtacgaacgtagtttacggtaggtgggtttaggg

SEQ ID NO: 350480 - DNA, 721 bp, Homo sapiens
  misc_feature: GZ8MTXP02JKWW0.19.59.F04.1.454.CMB.2.raw
  modified_base (171)..(171): a, c, t, g, unknown or other
  misc_feature (171)..(171): n is a, c, g, or t
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (311)..(311): a, c, t, g, unknown or other
  misc_feature (311)..(311): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctnagtgtctgcggccccaggacagaaggtcaccatctcctgctctggaagcagctccaanttgggaatattttgngtcctggtaccagcagctcccagaacagcccccaaactcctcattttgacaataataagcgaccctnagggattccctagaccgattctctggctccccaagtctggcacgtcacgccaccctgggccatccgaccggacctccacgaccgtggggaaccgagggcccgagtttaacttaccgtacgtcgggaaaccagttcggggaaacgttacggaccaacggtaccccgtagggtaacggtttaaaccgttcggtacggtaaagtttaaaacgggttccgggggaaccggggtaacgggggaaaaccccgtaaaggggaccctttacgggaacccccgggttacccggtaaacggggtttacccgaaccggtacccccggaaaacgggtcccggtaacccggtaccccccccggttacggggtccctaacccggtttccccgttcccgggtttaaccccccgtttacccccccg

SEQ ID NO: 350481 - DNA, 700 bp, Homo sapiens
  misc_feature: GZ8MTXP02JDIT9.19.59.F04.1.454.CMB.2.raw
  modified_base (243)..(243): a, c, t, g, unknown or other
  misc_feature (243)..(243): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgcctcagtgtctgcggcccaggacagaaggtcaccatctcctgctctggaagcagctccaacattgggaatattttgngtcctggtacagcagctccaggacacgaccccaaactcctactattttacgactaaataactaacgccgaccctacgacgggtacttcccgtgaccgtattctcgtcggctccccaagtctgctacgtcacgcccaccgtgggaccacgtaccgaccggacctcccgaacgtaccggtcggggaaccgacgggacccgttaagtttacgtaaccgttcggaccggaaacgacgtacggggaacgttacggacgaacggtacccgtggtaacggttaccgtgtaggtaacgttaaacggttccggggacgggtaacggggaaaccgtaacggtccgtacgggtaacccggttacccggtaaacggttaccgaaccggtaccccggaaacgggtccgtcccggtacccccgttacgggttacctacccgtttccggtttaccggttccccttaaccccg

SEQ ID NO: 350482 - DNA, 637 bp, Homo sapiens
  misc_feature: GZ8MTXP02G3X1O.19.59.F04.1.454.CMB.2.raw
  modified_base (244)..(244): a, c, t, g, unknown or other
  misc_feature (244)..(244): n is a, c, g, or t
  modified_base (272)..(272): a, c, t, g, unknown or other
  misc_feature (272)..(272): n is a, c, g, or t
  modified_base (395)..(395): a, c, t, g, unknown or other
  misc_feature (395)..(395): n is a, c, g, or t
tcagtactctcgtgcacgaccggtgctcgatttagtacacacacttagggattggggccctagccctggattccaaggcatttccacttggtgatcagcactgaacacagaggactcaccatggagttgggctgtgctgggttttccttgttgctattttagaaggtgtccagtgtgaggtgcagctggtggagtctgggggagcttggtacagcctggagggtccctgagactctcctgtgcngcctctggattccaccttcagtagttanagaaatgaattgggtccgccaggctccgagggaggggctggagtggttcatacattagtagtaggtggtagtagcaagtatactacgcagtactctggtagaacgggtccgaattccaaaccnttcctacccgaaggacgaaccacggccgacccaaaaggaacctcaaacgttgtaattcctagacctaaaagtcggaaacctaagggccctaaggggaacgacggacccggaagggaccctaacgggaccttaagggtttaactaaccgttgggtaggcggaaaggacggtaggtacggacgtaaaagggtgggtagggggtaccgtaagttaggtttaggtaacggttggggtttaacgggg

SEQ ID NO: 350483 - DNA, 786 bp, Homo sapiens
  misc_feature: GZ8MTXP02ILGMC.19.59.F04.1.454.CMB.2.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgcctcagtgtctgcggcccaggacagaaggtcaccatctcctgctctggaagcagctccaanttgggaatatttgngtcctggtaccagcagctccaggaacacgcccccaaactcctactattttagaacaaattaaataacgccgtaaccctcaagggactttcccgtagaccgtatttcctctcggccttaccccaaagttctggactacgtaccacgcccgaacccgttcggggaccaacgttcccgaaccgggtaccttacccgaaacggtaccgtacgggggaaccgaacggggtaccccgtaaattttaacgttaacccgttacgggtaacccgggtaaaaccgaggtacgggggtaaattaaccgggaaccgtaaacggtcccccggttaggtaaacgggttaaacccttgggttaaacggtaaagttaaaacgggttccgggggaaccggggttaacgggggaaacccgaaaacgggtccgtttaccgggacccggttacccgttaacggggtacctaaccgggaccccgaaagggtccccgtaacccggtacccccccgttacggggttcctaacccggttccctttcccggttacccccgtaaccccccg

SEQ ID NO: 350484 - DNA, 584 bp, Homo sapiens
  misc_feature: GZ8MTXP02ICHVX.19.59.F04.1.454.CMB.2.raw
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
  modified_base (290)..(290): a, c, t, g, unknown or other
  misc_feature (290)..(290): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
tcagtactctcgtgcacgaccggtgctcgatttagtacacacacttagggattgggggccctagccctggattccaaggcatttccacttggtgatcagcactgaacacagaggactcaccatggagttggggctgtgctgggttttccttgttgctattttagaaggtgtccagtgtgaggtgcagctggtggagtcgtggggggagcttggtacagcctggagggtccctgagactctcctgtgcagcctntggattcaccttnagtagtatgaaatgaatgggtccncaggctcgagggagggctggagttggttcatacagttagtagtagtggtagtagcatatactacgcagactctgtgaagggcctatccacatccncaganacagcgacaaagactcactgtactctagactaaagtcgaacacgtacctaggacgacggaccggaaggaccgtaacggtactttaagtttaacgtacgtcgggtagacggaacggtacgtacgggtacggaacgtaagggtcgggaacgggggtaccgtaacgtaggtttacggttacgggttagggttcgggg

SEQ ID NO: 350485 - DNA, 519 bp, Homo sapiens
  misc_feature: GZ8MTXP02I2VXL.19.59.F04.1.454.CMB.2.raw
  modified_base (275)..(275): a, c, t, g, unknown or other
  misc_feature (275)..(275): n is a, c, g, or t
  modified_base (316)..(316): a, c, t, g, unknown or other
  misc_feature (316)..(316): n is a, c, g, or t
  modified_base (401)..(401): a, c, t, g, unknown or other
  misc_feature (401)..(401): n is a, c, g, or t
  modified_base (428)..(428): a, c, t, g, unknown or other
  misc_feature (428)..(428): n is a, c, g, or t
  modified_base (431)..(431): a, c, t, g, unknown or other
  misc_feature (431)..(431): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (458)..(458): a, c, t, g, unknown or other
  misc_feature (458)..(458): n is a, c, g, or t
  modified_base (492)..(492): a, c, t, g, unknown or other
  misc_feature (492)..(492): n is a, c, g, or t
  modified_base (511)..(511): a, c, t, g, unknown or other
  misc_feature (511)..(511): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgcttgggttttccttgttgctattttagaaggtgtccagtgtgaggtgcagctgggtggagtcgtgggggagtcgttggtacagccgtgggacgggtccctgagactctctgtgcagcctngacttcaccttcagttattatagaaatgtaagttcgggccncgaggctaccggaaggggagggcgtggagttggttacagtacctagttagtagtagtggtagtagctatatacgtacgcaagctntgtagaacggtcatcactatcacaganacngacacaagactnactnatcagacaaancgacagcagacgagcgaagacacgtcgtaatttntactgtgacgagagtacgnggagtagg

SEQ ID NO: 350486 - DNA, 750 bp, Homo sapiens
  misc_feature: GZ8MTXP02HFRU3.19.59.F04.1.454.CMB.2.raw
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggcccaggacagaaggtcaccatctcctgctctggaancagctcaacattggaatattttgngtcctggtaccagcagctccaggaacacgacccccaaactcctctattttgaccaaattaacgtaaacgccgaacccctgaacgggtatttcccgtgtaacccggtaatttcctcgtcggtcctacccctaaacgttccttggacctaccggttcaacgcccctaacccgtggggccacgtccgaaccgggacctaccgaacgacgtacgggggacgacgggaccgtaagttacgttacgtgaccggaaacagtaggggaatacggtaccacggtacccgtaggtacggttaaccgttggtaggtaaagttaaacgggttaccgggggacgggggaaacggggttaacccaaaacgggtccgttaccgggtaacccggttaccggttaacgggtaccggaaccggtaccccggaaaacggttccccggtaacccggtacccccccgttcggggttaaaccccgtacctttaccccggttaccccggtttaccccccggttcccccccg

SEQ ID NO: 350487 - DNA, 613 bp, Homo sapiens
  misc_feature: GZ8MTXP02I4KW0.19.59.F04.1.454.CMB.2.raw
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (354)..(354): a, c, t, g, unknown or other
  misc_feature (354)..(354): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggccctgtctgtgttgacgcagccgccctcagtgtctgcggccccaggacagaaggtcaccatctcctgctctggaagcagctccaanttgggaatattttgngtcctggtaccagcagctccaggacacgcccccaaactcctcattttgacaataataagcgaccctcagggattcctgaccgtattctcctggtcctcccaagtctggcncgtccagcccacctgggcatcaccggactccagacgtggggacgaggccgagttatacgtgacggaacagtaggggataggcaacggccgtagacggttaactggtagtataaacggttcgggacggggagggaacccgaaaggtccgtacggaacccggttaccgtagggttaccacggtaccccgaacggggtacccgtccggccccccgttacggttccgaacccgtttccgttcccggggtttccccctcccccg

SEQ ID NO: 350488 - DNA, 766 bp, Homo sapiens
  misc_feature: GZ8MTXP02HBIDJ.19.59.F04.1.454.CMB.2.raw
  modified_base (229)..(229): a, c, t, g, unknown or other
  misc_feature (229)..(229): n is a, c, g, or t
  modified_base (245)..(245): a, c, t, g, unknown or other
  misc_feature (245)..(245): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaanttgggaataattttgntcctggtaccagcagctccaggacacgcccccaaactcctactatttttagaactaaattaaataacgaccgaaccctcgaacgggtactttccctacggaacccgtacttccgttacgtcggtcctaccccgtaagtccgtcggacctacgttccaacgccccctaacccgttcggggacctacgtacccgaacccggaccttacccgaaccgacgttacgggggaccgaacggggtacccgtaagtttaacgtttaaccgtacgggtaacgggaaaacctaagggttaggggaaaccgttaagggaccgacgggtacccgttagggtaacgggttaaccgtagggttaccgtaaggttaaacggttcggggaccgggggtaaacgggaacccgtaaaacggcggttaaccggtaacccggtttaccgtaaaacggttccaacggaccccgaaagggtcccttaacccggcccccgtttacggtacctacccgttccgttccgttacccccgtacccccg

SEQ ID NO: 350489 - DNA, 835 bp, Homo sapiens
  misc_feature: GZ8MTXP02GCZMV.19.59.F04.1.454.CMB.2.raw
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggcccaggacagaaggtcaccatctcctgctctggaagcagctcaanttgggaatattttgngtcctggtacagcagctccaggaacacgacccccaaactcctactattttagaactaaataaataacgaccgacccctacgacgggtacttacccgtacgtaacccgtaactttccgtcgtcgggtaccttaccccgtaaacgttccgtacgggtacctaaccggttacccgaacggtcccccgtaacccccgttcgggggaccctaaaccgttacccgaaaccccggggtaacccgttaccccgtaaacgggtaacccggttaccggggggaaacccgggaacggggtaaccccggttaaagttttaaacgttaacccggttacgggaacccgggtaaaaccgtaaaggttacggggtaaacgttaacggaccgtaaaccgggtcccgttaggtaacggttaaccgtaggttaggtaacgttaaacggtaccggggacggggaaaccggggaaccgaaaacgggtccgtacggtaacccggttacccggtaacggttaccgaaccggtaccccgaaacgggtcccgtaacccggtaccccccgttacgggtaccctaccgttcccgttacccggtttaccccctaacccccg

SEQ ID NO: 350490 - DNA, 712 bp, Homo sapiens
  misc_feature: GZ8MTXP02HKPX9.19.59.F04.1.454.CMB.2.raw
  modified_base (250)..(250): a, c, t, g, unknown or other
  misc_feature (250)..(250): n is a, c, g, or t
  modified_base (376)..(376): a, c, t, g, unknown or other
  misc_feature (376)..(376): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggccccaggacagaaggtcaccatctcctgctctaggaagcagcctaccaatagttaggaatattttgngtccgtggtaccagcagctccaggacacgaccccaactcctctattttgactaataatagccacctgaggacttcctagaccgtattctactcggcctacccaagtctaggcaccgtaccaacccncccgtcggactacgtacccgacccggtactccaacgaccgtaggggaaccgtacgggacccgtatttaacgttacgtaggacccggtaaataggtacgggaattacggacgtaaacggtcccgttaggtaacgttaccgtaggttagtaaacgtaaacggtccggggaacggggtaaccgggtaaaccgaaacggtaccgtacggtaaaaccccggttccggtttaaacggtaccgaaacccggtacccgaaacggtcccgtaacccgtccccccggttcggtacccgttacccttaccgtttcccccgttacccccggtccccgtttaacccccg

SEQ ID NO: 350491 - DNA, 801 bp, Homo sapiens
  misc_feature: GZ8MTXP02I3SSK.19.59.F04.1.454.CMB.2.raw
  modified_base (242)..(242): a, c, t, g, unknown or other
  misc_feature (242)..(242): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgcctcagtgtctgcgcccaggacagaaggtcacatctcctgctctggaagcagctccaatagttggaagtattttgngtcctggtaccagcagctccaggaccacgacccccaaactcctactattttgaacctaaataaactaacgccgtaacccctcgaacgggtactttcccgtcgtacccgtactttcctcctaggtcctaccccgtaaacgttccgttacgggacctaacgttccgaacgtccccgtaaccccgttcggggacctacgtacccgaacccgggtaccttacccgaaacgggtaccggtacgggggaaccggaaacggggtcccgtaaagttttaaacgttaccggttagggaaccgggaaacgtaggttcggggaaacgttacggaccgaaacggttcccgtagggtaacggtttaaccgtggtaaggtaacgttaaacggtaccggggacggggaaacgggggaacccaaacgggtaccgtacgggtaaaccccgttaccggtaaacgggttaccgaaaaccgggcccccgtaaaacgggtcccgttaacccggtaccccccggttcgggttaccctaacccggtttcccgttccccgggtttcccccggttaaccccccg

SEQ ID NO: 350492 - DNA, 570 bp, Homo sapiens
  misc_feature: GZ8MTXP02HMCJP.19.59.F04.1.454.CMB.2.raw
  modified_base (263)..(263): a, c, t, g, unknown or other
  misc_feature (263)..(263): n is a, c, g, or t
  modified_base (288)..(288): a, c, t, g, unknown or other
  misc_feature (288)..(288): n is a, c, g, or t
tcagtactctcgtgcacgaccggtgctcgatttagtacacacacttagggattgggggccctagccctggattccaaggcatttccacttggtgatcagcactgaacacagaggactcaccatggagttggggctgtgctgggttttcctgttgctattttagaaggtgtccagtgtgaggtgcagctggtggagtctgggggagcttggtacagcctggagggtccctgagactctcctgtgcagcctctggattcaccttnagtagttatgaaatgaattggtccncaggctcgagggaggggctggagtggtttcatacatttagagttagtggtagtagcatatactacgcagaccttcgtggtaggaaaggggtcccatttccaaccatcctccagacgacagcgaccaagactcactgtactctagactaaatcgaaacagcctaggacgacggaccggaagacgaccgggacttaagtttacttaactggtacgacggaggtaacggacggtggacaagggtggacggggttacgactaaggtttcggtaggttgggttaggg

SEQ ID NO: 350493 - DNA, 557 bp, Homo sapiens
  misc_feature: GZ8MTXP02F0E93.19.59.F04.1.454.CMB.2.raw
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (427)..(427): a, c, t, g, unknown or other
  misc_feature (427)..(427): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctcaacattgggaanatttgngtctgtaccagcagctccaggaacacgacccccaaactcctctattttgacaaataataagcgaccctcaggacttcctgaccgtattctctggctccaagtctggcacgtcacgccacctggcactcaccggactccagcgtggggacgaggccgatttataccgtgacggaacagtgggaanagcacgcgtagtacgtagtgagtaagtacgtcggacggaacggacgaacgcgtacgtaccgtacgtacggacgaccgaccgacgccgtccgccccgtacgtacctaccgtccgtcccgtacccctacccg

SEQ ID NO: 350494 - DNA, 690 bp, Homo sapiens
  misc_feature: GZ8MTXP02I3QBY.19.59.F04.1.454.CMB.2.raw
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggcccaggacagaagtcaccatctcctgctctggaagcagctccaacattagggaataattttgcgtcctggtaccagcagctccaggaacacgcccccaaactcctctattttgaactaaataaataacgccgaacccctcgaaggggatttccctagaccgtatttcctcgtcggctaccccgtaagtccgtggccacgtcacgcccacccgtcggggcacgttccgaaccggtacctcccgaaacgtaccggttacgggggaaccggaacgggtcccgtaatttaacgttaccgtacggaccggaaacgtagtaggggataaggcaacgccgtaggacgtaacgtgtagtaagtaacgtccgggaggaacgggaacgaaacggtcgtacggacccggtaaccgtacgggtacctaaccggtacccgaaacgggtcccgtaacccggtccccccgttacggggtaccctaaccgtttacccgtcccggtttacccccgtaaacccccg

SEQ ID NO: 350495 - DNA, 574 bp, Homo sapiens
  misc_feature: GZ8MTXP02I9IEB.19.59.F04.1.454.CMB.2.raw
  modified_base (246)..(246): a, c, t, g, unknown or other
  misc_feature (246)..(246): n is a, c, g, or t
  modified_base (297)..(297): a, c, t, g, unknown or other
  misc_feature (297)..(297): n is a, c, g, or t
tcagtactctcgtgcacgaccggtgctcgatttagtacacacacttagggattgggggcagaaggcaggactcgggacaatcttcatcatgacctgctccccctctcctcctcacccttctcattcactgcacagggtcctgggcccagtctgtgttgacgcagccgccctcagtgtctgccggccccaggacagaagtcaccatctcctgctctggaagcagctccaacattgggaatattttgngtcctggtaccagcagctccaggaacacgccccaaactcctctattttganaaataataacgccaccctcagggattccctgaccgtattctctggctcccaatctggcacgtcacgccacctgggacactccgaccggactcccgagacgtcggggacgacggccgattatacgtgacgaacagtgggatagcagcctagagtactgtagataggacggcgggagggacctaaggcgtacggtaccggtcgttaagggaccacggaccccgaaggcccgtccgcccccgtagggtccctaacgttcctccggttacccctacccccg

SEQ ID NO: 350496 - DNA, 836 bp, Homo sapiens
  misc_feature: GZ8MTXP02I6M3I.19.59.F04.1.454.CMB.2.raw
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggccccaggacagaaggtcaccatctcctgctctggaancagctaccaanttaggaatattttgngtcctgtacagcanctccaggacacgaccccaaactcctactacttttagaactaaataacgtaaacgaccgtaacccgtacgaacgggtacctttacccgtacggtaaccgtacttccttcgtacggtcctaccccgtaaacgttccgtacggaccgtaccgtacgtaccgccccgtaacccgtcggggacctaccgtaccgtaacccggtaaccgtacccggaaacgtaaccggttacgggggaacccgtaacggggtaacccgttaaacgtttacgtttaacccggtacggtaacccgggaaaactacgggtaaggggtaaacgttaacggtaccggaaacggtacccgttaagggtaaccggtttaaccgttacgggttaacgtaaaggttaaacgggttaccgggggtaacgggtaaaccgggggtaaaaccccgaagggtaacccgttaccgggtaaccccggtttaacccgtaaacgggttacccggaaccgtacccggtaaaccgggcccgttaaccccggtcccccgtacgggtacccctaccgtttaccccgtttccccgttacccccgttaaccccccg

SEQ ID NO: 350497 - DNA, 607 bp, Homo sapiens
  misc_feature: GZ8MTXP02ITWAJ.19.59.F04.1.454.CMB.2.raw
  modified_base (497)..(497): a, c, t, g, unknown or other
  misc_feature (497)..(497): n is a, c, g, or t
tcagtactctcgtgcacgaccggtgctcgatttagtacacacacttagggattgggggcagaaggcaggactcgggacaatcttcatcatgacctgctccccctctcctcctcaccccttctcattcactgcacagggtcctgggcccagtctgtgttgacgcagccgccctcagtgtctgcgccccaggacagaaggtcaccatctcctgctctggaagcagctccaacagttgggaagtaattttgtgtcctggtaccagcagctcccaggaaccacgacccccaaactcctactattttacgaacaaattaaataacgaccgaccccttacgacgggtactttccctagacccgtacttcctctcggcctaccccgtaagtccgtaggccacgtccgacgtcccacccgtcgggaccatcccgaaccggactcccgagacgtgggacgacggcctattactcgtgacggaacagtggatcgcagctagagtacngtagattacgcgggtacggacggaacaggcgtacggaccgtacgtaggtacacgacccgaaggcctaaccgcccccgttcgtaccacgttccttaccgtcccctaccccg

SEQ ID NO: 350498 - DNA, 563 bp, Homo sapiens
  misc_feature: GZ8MTXP02HD9V8.19.59.F04.1.454.CMB.2.raw
  modified_base (234)..(234): a, c, t, g, unknown or other
  misc_feature (234)..(234): n is a, c, g, or t
  modified_base (421)..(421): a, c, t, g, unknown or other
  misc_feature (421)..(421): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (491)..(491): a, c, t, g, unknown or other
  misc_feature (491)..(491): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttcctgttgctatttagaaggtgtccagtgtgaggtgcagctgggtgggagtcgtggggggagcttgggacnggccgtgggagggtccctggagactctcctgtgcagcctctggacttccacttcagtagttatagaaatggaagtttcgggtcccaccgtaggcctccggaaagggggacggggcttaggggtaggttggggtttccaagtacctagttaggtagtagtggtagtagctatatactagctaggactntgtaggaacggccattcaaccntccncagagacagcacaagactcattgatccgagtacaaatcgaaacngactggaagacgccgaaggacaccggattaggtttaatcgtaaggtgacggtagagaggtcggactaagggg

SEQ ID NO: 350499 - DNA, 644 bp, Homo sapiens
  misc_feature: GZ8MTXP02JT5KT.19.59.F04.1.454.CMB.2.raw
tcagtactctcgtgcacgaccggtgctcgatttagtacacacacttagggattgggggccctagccctggattccaaggcatttccacttggtgatcagcactgaacacagaggactcaccatggagttggggctgtgctgggttttccttgttgctattttagaaggtgtccagtgtgaggtgcagctgggtggagtcgtgggggagtcttggtacagccgtgggacgggtccctgacgactctcctgtgcagcctcgtggtacttccaccttcagttagttatagaaaatgtaagttcggggcccgccgaggcctaccggaaggggaacggggtctgggaggttgggtttacagtaactagtttagtagttaggtggtaagtagctaatataaccgtacgcagtacctgtggaggaaaggggccctattccacctatccctaccagaacgacgacgcgaaccaaagtacctcacgtgtactactagacaaagtacgaacgacgaccgtagaacgaccggaccggaaggaccgaaccggtacttaaggtttaacttacggtggtaggacggtaaggaaggtacgggtcgaacgtaagggtcggtaggggtaccgtagtaagtttgggtaggttgggttagggg

SEQ ID NO: 350500 - DNA, 793 bp, Homo sapiens
  misc_feature: GZ8MTXP02JNS05.19.59.F04.1.454.CMB.2.raw
  modified_base (217)..(217): a, c, t, g, unknown or other
  misc_feature (217)..(217): n is a, c, g, or t
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggcccaggacagaggtcaccatctctgctctggaancagctacaacagttaggaatatttgngtcctggtaccngcagctccagacacgaccccaaactcctctattttgaactaataaataacgaccgaaccctacgaagggtactttacccgtacgtaaccgttaacgtttccgttacgtcgggtaccttaccccccgtaaaacggttcccgtttacggggaccctaccggttaccgaaccggtcccccgtaaacccccgttcgggggtacctaacgttacccgaaccccggggtaccttacccgaacgggtaccggtacgggggaaccgacgggtacccgttaagtttaacgttaccggttacggaaccgggtaaacgacggttacggggaacgttacggaccgaacggtcccgttagggtaacggttaccgtacggttagtaacgtttaaacggtcgggaccggggtaacgggaaaccgaacggtacgtaccgggtaacccgtaccggtaacggtacgtaacccggacccgtaaacggtcccgtaacccggtacccccgttcggtacctacccgttacccgtttacccggtacccccgttaccccccg

SEQ ID NO: 350501 - DNA, 615 bp, Homo sapiens
  misc_feature: GZ8MTXP02HSUSI.19.59.F04.1.454.CMB.2.raw
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagcctccaacagttagggaagtaatttttgtgtcctggtaccagcagctcccaaggacacgacccccaaactcctctattttcgaactaaataataacgccgaccctcagggtacttcctgaccgtattctcgtcgctcccagtctgcacgtcacgcccaccgtgggacacgtaccaccggacctcccgagacgtcggggacgacggccgtaatttacgtacgtacgacggaacagtgggactacgcgacggccgttaggtacgtacgttaggtacgtagtaaaggtcgggaacggacgggaacgaacggcgtacggtaccgtaccgtacgggtccacggacccaacggcctccgccccgtacggtccctacgtcccgtccgttacccctacccc

SEQ ID NO: 350502 - DNA, 507 bp, Homo sapiens
  misc_feature: GZ8MTXP02GRXI8.19.59.F04.1.454.CMB.2.raw
  modified_base (271)..(271): a, c, t, g, unknown or other
  misc_feature (271)..(271): n is a, c, g, or t
  modified_base (282)..(282): a, c, t, g, unknown or other
  misc_feature (282)..(282): n is a, c, g, or t
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
  modified_base (373)..(373): a, c, t, g, unknown or other
  misc_feature (373)..(373): n is a, c, g, or t
  modified_base (442)..(442): a, c, t, g, unknown or other
  misc_feature (442)..(442): n is a, c, g, or t
  modified_base (450)..(450): a, c, t, g, unknown or other
  misc_feature (450)..(450): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctgggtggagtcgtgggggaggcttggtacagcctgggaggtccctgagactctcctgtgcagcctnggattcacttnagtatangaaatgaattggccncaggctcgagggagggctggagtggttcataccattagtagtagtggtagagcatatactagcagactntgtgaaggccattcacctatcctcgaagagacagccgacaaagactcactgtaatcagacaaatgaacngcagacgngccgaaggacacggctaagtttactacgtgtcgacggagagaggtacggactaaggg

SEQ ID NO: 350503 - DNA, 667 bp, Homo sapiens
  misc_feature: GZ8MTXP02GI72J.19.59.F04.1.454.CMB.2.raw
  modified_base (347)..(347): a, c, t, g, unknown or other
  misc_feature (347)..(347): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgcttgggttttccttgttgcttattttagaaggtgtcagtgtgaggtgcaggcgtgggtggagttcggtggggggagtcgttgggtacaggtccgtgggacgggttccctggacgtaccttcgtccgtgtcgcacgtcctcgtggtactttccaccttgagttagttatagtaaatggtaagttcggggaccnccgaggtcctaccggaaggggacgggtcgtagggtaggttgggttacaattaccgtagttaggtagtaggttaggtagtagctaatactacgtacgctagtctcgtagtagacggaccgtactaccgaacctactcctacgaacgacgacgacgaccgaaccgaaacgtaacctacgtaacttacgttactacgtagaacccccgtaaagtaacgaacgacgaccgaggaacggaacggaccggaacggaaccgaacggtacgttaacgtttacgttacgtaaggtacggacgtaggaggtacggtaggacgtaaagggg

SEQ ID NO: 350504 - DNA, 638 bp, Homo sapiens
  misc_feature: GZ8MTXP02JNZAX.19.59.F04.1.454.CMB.2.raw
tcagtactctcgtgcacgaccggtgctcgatttagtacacacacttagggattgggggcagaaggcaggactcgggacaatcttcatcatgacctgctccccctctcctcctcacccttctcattcactgcacagggtcctgggcccagtctgtgttgacgcagcccgccctcagtgtctgccgcccaggacagaagtcacatctcctgctcgtggaagcagctaccaatgttaggaatatttgcgtctggtaccagcagcctccaaggacaccgaccccaaactcctctattttagaactaataaatacgacctaccctagacggtacttcctacgaccgtattcctcgtcgactacccgagtctagccacgtccacgcccgaccgtgggacctacgtccgaaccgtactaccgaacgtacggtacggggacgacggtacgtattacgttaccgaggacggaactaggtaggtacacgtacgacggtccgtaggtaccgtaagtagtaaggtaacgttacggacggggacggaaggacgaaacggtcgttacgaccgttacgacgtacgaccgaccgacggtcccgtcccgtccccgtacggtacctaccgtttccgtacccgtaccccttaccccg

SEQ ID NO: 350505 - DNA, 611 bp, Homo sapiens
  misc_feature: GZ8MTXP02H7RCD.19.59.F04.1.454.CMB.2.raw
  modified_base (251)..(251): a, c, t, g, unknown or other
  misc_feature (251)..(251): n is a, c, g, or t
  modified_base (264)..(264): a, c, t, g, unknown or other
  misc_feature (264)..(264): n is a, c, g, or t
  modified_base (290)..(290): a, c, t, g, unknown or other
  misc_feature (290)..(290): n is a, c, g, or t
tcagtactctcgtgcacgaccggtgctcgatttagtacacacacttagggattgggggccctagccctggattccaaggcatttccacttggtgatcagcactgaacacagaggactcaccatggagttggggctgtgctgggttttccttgttgctattttagaaggtgtccagtgtgaggtgcagctggtggagtctggggggagcttggtacagcctggagggtccctgagactctctgtgcagcctntggattcaccttnagtagtatgaaatgaattcgggtccncaggctcgaggggagggctggagttggttcagtacagttagtagtagtggtagtagcatatactacgcagacttctggtaggaaacgggtcccaagttccaaccctatcctacccgagaacgacgacgccgaccaaagacctacacgtgtactcgtagaactaaagtgaaaccagccctaggacgagacccggaggaaccgaccgggtactaagtttttaacgtacgtggttacggacgaagggaggtacgtagggacgaaagggtcggggtaaaggggtacccggtaattagtttacgggtagggtttacgggttagggg

SEQ ID NO: 350506 - DNA, 756 bp, Homo sapiens
  misc_feature: GZ8MTXP02FSW5Z.19.59.F04.1.454.CMB.2.raw
  modified_base (216)..(216): a, c, t, g, unknown or other
  misc_feature (216)..(216): n is a, c, g, or t
  modified_base (242)..(242): a, c, t, g, unknown or other
  misc_feature (242)..(242): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggcccaggacagaagtcacatctctgctctggaancagctccaatagttggaatattttgngtcctggtaccagcagctccaggacacgccccaaactcctctattttgacaataataacgcgaccctcaggacttccctacgaccgtacttcctactcggtcctaccccgtaaagttccgtcgggacctacggtccacgtccccaaacccgttcggggacctaacgtccgaacccgggtacctacccgtaaggaaccgttacgggggaaccgacgggtaccggtaacgtttaacgttaacccgttaggaaccgggtaaaactacggtagggggtaaacgttaaacggccgaaacggtcccgtacgggtaaagtttaacccggtaggtttacggaaagtttaacggttacgggggacggggtaaacggggaacccgtaaaaggcccgtaacgggtaccccgtttaccggtaaacgggttacccgacggttaacccccgaaggggtcccgttaacccggaccccccgttcggtacccgtacccgtccgtttaaccccgtccccctttaaccccccg

SEQ ID NO: 350507 - DNA, 666 bp, Homo sapiens
  misc_feature: GZ8MTXP02JHC8Z.19.59.F04.1.454.CMB.2.raw
  modified_base (294)..(294): a, c, t, g, unknown or other
  misc_feature (294)..(294): n is a, c, g, or t
  modified_base (303)..(303): a, c, t, g, unknown or other
  misc_feature (303)..(303): n is a, c, g, or t
  modified_base (320)..(320): a, c, t, g, unknown or other
  misc_feature (320)..(320): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgcttgggttttccttgttgcttattttagaggtgtccagtgtgaggtgcagctggtggagtcgtggggggagtcgttggtacagtccgtgggacgggtccctgacgctctcctgtcgcagcctcgtggtacttcaccttnagttattangaaatgaagttcggccncgaggctcggaggggagggctgggtagttgggttacataccgtagtttagaggttaggtaggttacgtagcgtaattattaaaccgtacgactaacggtacttccggtaggtacgggaaacgggggtcccttaacgttacccaaccctaattcccgacccgaagaacgaccgaaccggacccggaaaccaaaacggtaaccttaccgaaacttcgggtaaacctcgtaacgaactaaaagtacgaaaccgcgaccgtaggaacgacggacccgaagggaacccgtaggtaccttaaggttttactacgtaaggtacgacggtacgaggagttacggcggtaaaggg

SEQ ID NO: 350508 - DNA, 682 bp, Homo sapiens
  misc_feature: GZ8MTXP02IYEB0.19.59.F04.1.454.CMB.2.raw
  modified_base (211)..(211): a, c, t, g, unknown or other
  misc_feature (211)..(211): n is a, c, g, or t
  modified_base (221)..(221): a, c, t, g, unknown or other
  misc_feature (221)..(221): n is a, c, g, or t
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
tcagtactctcgtgcacgaccggtgctcgatttagtacacacacttagggattgggggcagaaggcaggactcgggacaatcttcatcatgacctgctcccctctcctcctcaccattctcattcactgcacagggtcctgggcccagtctgtgttgacgcagccgccctcagtgtctggccgccccaggacagaaggtcaccatcctccngctctggaancagctaccaatgttgggaatattttgngtcctggtaccngcagcctaccagaacaccgaccccaaactcctactattttacgaactaaataagtaacgaccgtaccctagacggtacttccgacgtaccgtattcctacgtcggaccctaccgtaagtcctacggacctaccgtcgaccgccctaacccggtgggaccctacgtcccgaaccgtaccctaccgacggaccggtacggggacgacggtacccgtaatttaccgtacgtacgggtaccgaaacgtagtaacggggaatacggacgtaacgtccgttaggtacgtaacgtggtaagtaacggttaaacgcggggaacggtaacggggaacctacggtacgtacggacccgtacgtacggccgtaacgacccgaacggtccgtccccggacccgttcggtacctccgtccgtccccgttaccccc

SEQ ID NO: 350509 - DNA, 607 bp, Homo sapiens
  misc_feature: GZ8MTXP02IQ4D6.19.59.F04.1.454.CMB.2.raw
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctatttagaaggtgtccagtgtgaggtgcagctggtggagtcgtggggggaggcttggtacagccgtggagggtcctgagactctcctgtgcagcctcgtggacttcaccttcagttagtatagaaatgtaagttcgggtccgaccgaggctccggaaggggaacggggtctggggagttggggttacagttacctagttagtagtaggttggtaacgttagctaattactactacgacagacttcgtggtgaaacggggtccaagttcccaacctatccctaccaaggacgacacggaccgaaccaaagtaacctcgaacttgtaactccgtagaacaaacgtcgaaaacgcgtcctaggaacgacgaccggaaaggaccacgggtacttagtttactacgtgtacggacggtagaaggtgtacggactaaggg

SEQ ID NO: 350510 - DNA, 633 bp, Homo sapiens
  misc_feature: GZ8MTXP02IDWEO.19.59.F04.1.454.CMB.2.raw
  modified_base (230)..(230): a, c, t, g, unknown or other
  misc_feature (230)..(230): n is a, c, g, or t
  modified_base (462)..(462): a, c, t, g, unknown or other
  misc_feature (462)..(462): n is a, c, g, or t
  modified_base (506)..(506): a, c, t, g, unknown or other
  misc_feature (506)..(506): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgcctcagtgtctgcggccccaggacagaaggtcaccatctcctgctcgtggaagcagctccaacnttagggaataattttgtgtcctggtaccagcagctccaggaacacgacccccaaactcctctatttttgaacctaaataaataacgccgaacccctgaaggggtactttccgtacgaccgtattcctctcggcctaccccgaagtcctggccacgtcacgcccacccgtgggccatccgaccggactccagacgtggggacacggaccgtattataccgtgacggaactagnggatacgcagtccgttagagttacgtgtagtaatagtaccgggnggaacgggaaccgaacggtcgtacggaaacccgttccgttaacggccgacggaccccgtaaggtcccgtcccggtccccccgttacgggtaccctaaccgttcccgtttccggttacccctaccccg

SEQ ID NO: 350511 - DNA, 505 bp, Homo sapiens
  misc_feature: GZ8MTXP02I4MXO.19.59.F04.1.454.CMB.2.raw
  modified_base (267)..(267): a, c, t, g, unknown or other
  misc_feature (267)..(267): n is a, c, g, or t
  modified_base (291)..(291): a, c, t, g, unknown or other
  misc_feature (291)..(291): n is a, c, g, or t
  modified_base (356)..(356): a, c, t, g, unknown or other
  misc_feature (356)..(356): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
  modified_base (388)..(388): a, c, t, g, unknown or other
  misc_feature (388)..(388): n is a, c, g, or t
  modified_base (390)..(390): a, c, t, g, unknown or other
  misc_feature (390)..(390): n is a, c, g, or t
  modified_base (400)..(400): a, c, t, g, unknown or other
  misc_feature (400)..(400): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (459)..(459): a, c, t, g, unknown or other
  misc_feature (459)..(459): n is a, c, g, or t
tcagtactctcgtgcacgaccggtgctcgatttagtacacacacttagggattgggggccctagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttgggtacagcctggagggtccctgagactctcctgtgcagcctctggattcaccttnagtagtatgaaatgaattgggccncaggctcgagggagggctaggagtggttcatacattagtagtagtggtatagcatatactacgananactngtagaaggcctatcaacatcacagananagacacaaanacnatnancaganaaananacagacagagagacgacgacgacgacgtagttatactagngacgagagagagagaagaaggaggacggacgagtagtagtaggtgg

SEQ ID NO: 350512 - DNA, 684 bp, Homo sapiens
  misc_feature: GZ8MTXP02GPGA2.19.59.F04.1.454.CMB.2.raw
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggcccaggacagaagtcaccatctcctgctctggaagcagctccaactagttgggaataatttttgcgttcctggtaccagcagcctcccaggaaccacgacccccaaactcctactattttgaactaaataaactaagaccgaccctacgaagggtactttcctaggaccgtacttccgtctcggcctaccccaagtctggcacgtcacgcccacccgtggccacgtccgaaccggactcccgagacgtaggggacgacggtcgtaatttagtactggacggtaaacagtacgggaatacggactacgggtaccttaggaacggttaaccgtgttaaggtaagttaaaacggtcgggggaacggtaacggggaaccgtaaacgcggtaaccggtacccggttacgttaacggcccgaacggtacccgaaccggtccgtaaccccggtcccccgttacggttaaccctaccgtttcccgttaacccgtttccccctaacccccg

SEQ ID NO: 350513 - DNA, 548 bp, Homo sapiens
  misc_feature: GZ8MTXP02FLIFB.19.59.F04.1.454.CMB.2.raw
  modified_base (229)..(229): a, c, t, g, unknown or other
  misc_feature (229)..(229): n is a, c, g, or t
  modified_base (245)..(245): a, c, t, g, unknown or other
  misc_feature (245)..(245): n is a, c, g, or t
  modified_base (285)..(285): a, c, t, g, unknown or other
  misc_feature (285)..(285): n is a, c, g, or t
  modified_base (325)..(325): a, c, t, g, unknown or other
  misc_feature (325)..(325): n is a, c, g, or t
  modified_base (337)..(337): a, c, t, g, unknown or other
  misc_feature (337)..(337): n is a, c, g, or t
  modified_base (353)..(353): a, c, t, g, unknown or other
  misc_feature (353)..(353): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctacaanattgggaatattttgngtcctggtacagcagctccaggacacgcccccaaatcctntatttgaactaataataagcgaccctgacggtattacccngaccgtattctntcggtctcccaagtcnggacacgtcacgccaccgtggcatccacggactcagacgtgggacaggccaattagactgacggaaanagtaganagacacgtcgtagacgtagtagtagagtacgcgggacggaacggacgacgtacgtacgtaccgtacgtacggtacacgacgacgctccgaccgtacgactactcgtacctacccctaccg

SEQ ID NO: 350514 - DNA, 682 bp, Homo sapiens
  misc_feature: GZ8MTXP02GVFC4.19.59.F04.1.454.CMB.2.raw
  modified_base (647)..(647): a, c, t, g, unknown or other
  misc_feature (647)..(647): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgcttgggttttccttgttgcttattttagaaggtgtcctagtgtgaggtgcagctgggtggagtcgtgggggaggtcgttggtacaggtccgtgggacgggtccctggagtactctcctgtgcacgcctcgtggactttccaccttcagttagttatagaaatgtaacgttcggggtccaccgaggacctcggaagggggacggggtcgttagggtaacggtttgggtttacaagttaacgttagtttaaggttaggttaaggttggttaagtacgtcgtaaattaacgttaaccgttaacgacgaacgttacgttccgtagttacgggaaaccggtccgtaatttcccgaaccttacgttcccacccgaagaacgaccgacgacccggaaccaaaagaccttacgactttggtaactccgtagaactaaagtaacgaacacgtccgaaggacgacgcgaacggaactacgggtaccttaagtttacttaggnggtagacgtaggacggtacggtacgaacggtaagg

SEQ ID NO: 350515 - DNA, 521 bp, Homo sapiens
  misc_feature: GZ8MTXP02JW7KO.19.59.F04.1.454.CMB.2.raw
  modified_base (274)..(274): a, c, t, g, unknown or other
  misc_feature (274)..(274): n is a, c, g, or t
  modified_base (312)..(312): a, c, t, g, unknown or other
  misc_feature (312)..(312): n is a, c, g, or t
  modified_base (366)..(366): a, c, t, g, unknown or other
  misc_feature (366)..(366): n is a, c, g, or t
  modified_base (377)..(377): a, c, t, g, unknown or other
  misc_feature (377)..(377): n is a, c, g, or t
  modified_base (403)..(403): a, c, t, g, unknown or other
  misc_feature (403)..(403): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctgggtggagtcgtgggggagcttggtacagccgtgggaggtccctgagactctctgtgcagcctctggnttcaccttcagttacgttatgaaatgaagtttgggccnccgaggcctcgaggggaggctggagtggttcataccattagtagtagtggtagncatatactagnagactctgtgaggcgatccacgatcncagagacagcaccaaagactcactgtatcctagactaaatcgaaacagtccaggacgacgccgaggtaccacggtactaaggtttatacgtgtacgacggagagaggtagacgaaggg

SEQ ID NO: 350516 - DNA, 556 bp, Homo sapiens
  misc_feature: GZ8MTXP02FI24Q.19.59.F04.1.454.CMB.2.raw
  modified_base (248)..(248): a, c, t, g, unknown or other
  misc_feature (248)..(248): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacagttgggaataatttttgngtcctggtaccagcagctccaggaacagcccccaaactcctctattttgacaataataagcgaccctcaggattcctgaccgtattctctggctccccaagtctgcacgtcagccacctggcactcacggactccagactggggacgaggccgtaattatactgacggaacagtgggatgacagcctgagtactgtagataagtcgggacggagggaccaaaggctacggaccgttaccgtacggtacacgacccgaaagggtcctcggcccccttcgggtccaccgtccgtcgtacccctaaccccc

SEQ ID NO: 350517 - DNA, 791 bp, Homo sapiens
  misc_feature: GZ8MTXP02HPG4X.19.59.F04.1.454.CMB.2.raw
  modified_base (244)..(244): a, c, t, g, unknown or other
  misc_feature (244)..(244): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggcccaggacagaaggtcaccatctcctgctctggaagcagctcaacagttaggaatattttgngtcctggtaccagcagctccaggacacgaccccaactcctactattttgactaaataataacgaccgaccctacgacgggtacttcccgtacgtaccgtattcctcgtcggtcctaccccaagtccgtacggacctacggttaccgaacggcccccgtaaccccgttcggggacccgtaccgttaccccgaacccccggtaacccgtaccccgaaacgggtacccgggtacgggggaacccggaaccggggtacccggttaacgtttaaaccgtttaaccgtacgggacccgggtaaaccgtaggttaccggggaaagttaacggaccgtaacggtacccgttaggtacggttacgtaggttagtaagttaaacggtcggggaccgggaacgggaaccgaacggtaccgtaccgggtaccccgttaccggtaacgggttaccgaaccggtacccggaaccggtaccccgttccccgggtaccccccgttaccgggttacccctaacccggtttcccgttaccccggtttaccccctaacccccccgg

SEQ ID NO: 350518 - DNA, 751 bp, Homo sapiens
  misc_feature: GZ8MTXP02GIS75.19.59.F04.1.454.CMB.2.raw
  modified_base (171)..(171): a, c, t, g, unknown or other
  misc_feature (171)..(171): n is a, c, g, or t
  modified_base (215)..(215): a, c, t, g, unknown or other
  misc_feature (215)..(215): n is a, c, g, or t
  modified_base (247)..(247): a, c, t, g, unknown or other
  misc_feature (247)..(247): n is a, c, g, or t
  modified_base (493)..(493): a, c, t, g, unknown or other
  misc_feature (493)..(493): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctnagtgtctgccggcccaggacagaacgtcaccatctcctgctcgnggaagcagctaccaatgttgggaatattttgngtcctggtaccagtcagctaccaggacacgacccccaaatcctctattttcgaactaaataactaacgccgtaaccctggaacggtactttacccgtaggaccgtaatttcctcgtacggtccttaccccgaagttccgtggaccgtaccggtacacgggcccctaacccgtgggacctacgtcccgaccggtactaccgacgtacgtacgggggacgacggggaccctaagtttaacgttaccgnggaaccggtaactacggtacggggtaaattacggacccgtaaagtcccgttagaaccgggttaactaggtacggtaaagtttaacgggtaccggggacgggtaaacggtaaccgaaaacggtcgtaccgggtaacccgttacggttaacggtaccgaacccggtaacccgaaacgggtcccgtaacccggtccccccgttaacggggtaccccttaccggttacccgtttaccccgggttaccccccgtttacccccg

SEQ ID NO: 350519 - DNA, 579 bp, Homo sapiens
  misc_feature: GZ8MTXP02JMOHW.19.59.F04.1.454.CMB.2.raw
  modified_base (221)..(221): a, c, t, g, unknown or other
  misc_feature (221)..(221): n is a, c, g, or t
  modified_base (251)..(251): a, c, t, g, unknown or other
  misc_feature (251)..(251): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggccccaggacaggaaggtcaccatctcctgctctggaancagcctaccaatagttagggaatattttgngtcctggtaccagcagctccagaccacgacccccaaactcctctattttgactaaataaataagccgaccctcgagggtacttccctgaccgtattcctctggctaccccagtctgctacgtcagcccacccgtgggacctactccgaccggcctccgacgacgtcggggacgacggcgtaagttataccgtgacggaacagtgggaatgacgacgccgtaggacgttactgtagacgtaagtcgggacggagggaccaagcgtacgaccgtcgtaaggcacgcccgaagcgccgccccgtcggtccaccgtcttccgtccctacccc

SEQ ID NO: 350520 - DNA, 752 bp, Homo sapiens
  misc_feature: GZ8MTXP02JV178.19.59.F04.1.454.CMB.2.raw
  modified_base (252)..(252): a, c, t, g, unknown or other
  misc_feature (252)..(252): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggcccaggacagaaggtcacatctcctgctctggaagcagcctaccgaactagttaggggaatatttttggngtccgttggtacccagcagctcccaggacacgcccccaaactcctactattttgaactaataataacgctaaccctcgacgggtactttcccgtacgtaccgtatttcctcctacggtcctacccgaacgtcgttacggcctaccgttaccgaacgccccgtaaccccgttgggggaccctaacgtcccgaccgggtaccttacccggaacgtaccgggtacgggggaccgacgggtaccccggttaagtttaagtacccgttaggacggaaacctaggttaggggaatacggacgaacggtccgtaggtacggttaacgtgtacgtaaagttaacggccggggtaacgggtaacggggacctaaaacggggcctaccggggtacccggttaccgttaaccggtaccggaccggaccccgaagggtcccgttaacccggacccccggtttcgggaccctaccgtttacccgttccccggtttacccccgtaacccccccg

SEQ ID NO: 350521 - DNA, 612 bp, Homo sapiens
  misc_feature: GZ8MTXP02JOJ90.19.59.F04.1.454.CMB.2.raw
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
  modified_base (459)..(459): a, c, t, g, unknown or other
  misc_feature (459)..(459): n is a, c, g, or t
  modified_base (489)..(489): a, c, t, g, unknown or other
  misc_feature (489)..(489): n is a, c, g, or t
tcagtactctcgtgcacgaccggtgctcgatttagtacacacacttagggattgggggccctagccctggattccaaggcatttccacttggtgatcagcactgaacacagaggactcaccatggagttgggctgtgctgggttttcctgttgctattttagaaggtgtccagtgtgaggtgcagctggtggagtcgtgggggagcttggtacagccgtgggacgggtccctgagacctctcctgtgcagccctntaggattccaccttnagttagttatagaaatgaattcgggcccaccgaggcctaccggaaggggacggggtctggggagttggtttcatactaagtttaggtagtaggtggtagtacgctaattactactaccgcaagtacctgtggtacggaaacgggcctaattccaccctatccaccagaagacaggcacccaaagtaccnctactagtactctagactaaaatcgaaacngacgtagaacgacgaccggagtacgacgtattagttattacgtgacgacggaagacggtacggtaggaacgtaagggtggaaccggggtacgtaagttaggtttaggtagggttagggttagg

SEQ ID NO: 350522 - DNA, 540 bp, Homo sapiens
  misc_feature: GZ8MTXP02FP336.19.59.F04.1.454.CMB.2.raw
  modified_base (293)..(293): a, c, t, g, unknown or other
  misc_feature (293)..(293): n is a, c, g, or t
  modified_base (310)..(310): a, c, t, g, unknown or other
  misc_feature (310)..(310): n is a, c, g, or t
  modified_base (365)..(365): a, c, t, g, unknown or other
  misc_feature (365)..(365): n is a, c, g, or t
  modified_base (377)..(377): a, c, t, g, unknown or other
  misc_feature (377)..(377): n is a, c, g, or t
  modified_base (513)..(513): a, c, t, g, unknown or other
  misc_feature (513)..(513): n is a, c, g, or t
  modified_base (528)..(528): a, c, t, g, unknown or other
  misc_feature (528)..(528): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctggtggagtctggggggagcttggtacagcctgggagggtccctgagactctcctgtgcagcctctggattccaccttcagtagttangaaatgaattgggtccncaggctccgaggggaagggctggagtggtttcataccattagagtagtgtagtancatatactacgnagactctgtggaacggcattcacatcctcaagagacagaccgccaaagaactacactagtatcgtagacaaaatcgaaacaggtaccagaacggacgccggaaggtaccgacggctaaagttttacaacttggacncggtaaggagtaggnggaaccgtaagg

SEQ ID NO: 350523 - DNA, 589 bp, Homo sapiens
  misc_feature: GZ8MTXP02GHHCO.19.59.F04.1.454.CMB.2.raw
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
  modified_base (312)..(312): a, c, t, g, unknown or other
  misc_feature (312)..(312): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctgggtggagtcgtgggggagcttggtacaggcctgggaggtccctggagactctcctgtgcagcctntggattcaccttnagttagttatgaaatgaagttcggccnccgaggcctccgaggggaacggggctgggagtgggttcagtacctagttagtagtagtggtagagcatatacgtacgcaagcttctgtagaacgggcctaattcaaccctatccctacaagagacagccgtaccaaagacctcacttagttactcgtagactaaaatcgaaacctagacctagggaacgacggacccggaaggaccctacgggacgttaaagttttacgttacgtaaggttcgacggaggtaacggtacggtacgggactaaagggg

SEQ ID NO: 350524 - DNA, 756 bp, Homo sapiens
  misc_feature: GZ8MTXP02HF4QY.19.59.F04.1.454.CMB.2.raw
  modified_base (214)..(214): a, c, t, g, unknown or other
  misc_feature (214)..(214): n is a, c, g, or t
  modified_base (250)..(250): a, c, t, g, unknown or other
  misc_feature (250)..(250): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggcccaggacagaaggtcaccatctcctgctcnggaagcagctaccaactagttagggaattattttgngtccgtggtaccagcagcctacccgaaggaaccaccgacccccaaactcctactaacttttagaactaaataaactaacgacccgaacccctacgaacgggtactttaccctacggtaccgtacttctaccgtcgggtcctaaccccgtaaacggttccgtacggggacctaccggttaccgaaccggtcccccgtaacccggtcgggggtacctaaccgttacccggaacccgggtaaacccttcccgaaacggtaccgggtaacgggggaaacccggaaccgggggtacccgttaaacgttttaacgttaaccgtacggaacccgggtaaacgacggtttaggggaaacgttacggacgtacggtaccgtagggtaacgtacgtagtagtaacgtaacggtcggggacgggaacgggtaaccgaacgtcgtacggtaccgtacgtacggacaccgaccgaagtccaaccgtcccgtcgtaccactccgtaccgtcccgtccccg

SEQ ID NO: 350525 - DNA, 793 bp, Homo sapiens
  misc_feature: GZ8MTXP02ILWT7.19.59.F04.1.454.CMB.2.raw
  modified_base (216)..(216): a, c, t, g, unknown or other
  misc_feature (216)..(216): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggcccaggacagagtcaccatctctgctctggaancagctaccaacagttgggaataatttgtgtcctgtaccagcagctccaggacacgacccccaaactcctctattttagacaaataaactaacgccgtaacccctgtaaggggtactttacccgtacgacccgtactttcctcgtacgggtcctacccccgtaagtccgtggacctacgtaccacgcccgtaaccccgtggggaccctacgtcccgtaacccgggaccctcccgaacgggtaccgggttacgggggaccgtaacgggtcccgtaagtttaacgttaccgtacggaccgggtaaactaggttacggggaaagttaccggactaacgggtcccgttaacgggtaaggtttaacccgtaggttacgtaaaggtttaaacggtacccgggggacgggggaaacggggtaacccggaaacgttacccggttacgggtaaaccccggtttacccggtaagggttacccgaacgggtaaacccccgaaggggttaccccggttaaccggtcccccccgggtttacggttacccgacccgtttaccgttccccggtttaccccctttaacccccgg

SEQ ID NO: 350526 - DNA, 758 bp, Homo sapiens
  misc_feature: GZ8MTXP02G2N0N.19.59.F04.1.454.CMB.2.raw
  modified_base (200)..(200): a, c, t, g, unknown or other
  misc_feature (200)..(200): n is a, c, g, or t
  modified_base (240)..(240): a, c, t, g, unknown or other
  misc_feature (240)..(240): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgcctcagtgtctgcgcccaggacagagtcacatcnctgctctggaagcagctaccaatagttaggaatattttgngtccgtggtaccagcagctccaggaacacgacccccaaactcctactattttacgaactaaataaactaacgaccgtaaccctacgacgggtactttacccgtagtacccgttattccgtcgtacggtacctaccccgtaacgttcctacgggtacctacggttccgaaccgcccccgtaaccccggtggggaccctaacgtcccgaacccgggtaccctacccgacggtaccggtacgggggaccgacgggtacccgtaattacgttaccggacgtaccgggtaaacaggttacgggaagttacgaccgacggtaccgtaggtaacgttaacgttgtaacggtaacgtaaacgggtcggggaacggggaacggaaaccgtaacggtaccgttaccggtaacccggttaccggttaacgggtacccgaaccgggtaccccgaacggtccccgtcccggtcccccgttacgggtacccttacccggttcccggtttacccggtcccccgtttacccccg

SEQ ID NO: 350527 - DNA, 590 bp, Homo sapiens
  misc_feature: GZ8MTXP02HFI8H.19.59.F04.1.454.CMB.2.raw
  modified_base (268)..(268): a, c, t, g, unknown or other
  misc_feature (268)..(268): n is a, c, g, or t
  modified_base (310)..(310): a, c, t, g, unknown or other
  misc_feature (310)..(310): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggtttccttgttgctatttagaggtgtcagtgtgaggtgcagctgggtggagtcgtgggggagcttggtacagccgtggacgggtccctggagactctctgtgcagcctntggattccaccttcagtagttatagaaatgaatttgggcccncaggcctccggaaggggaaggggctggggagttggggttcagtaccgtatttagtagtaggtggtaagtagctataatactacgcaggacttcgtgtagaaagggccgtattccacctatcctaccgagagacacgccgtaccaaaagtacctacacgttgtaactcgtagacctaaaagtcgaaactacgtcctaaggacgacgccggaaggaccgacgggtccttaaggttttataacgtggttacggccgaagtaggtacggtaggaactaaagggg

SEQ ID NO: 350528 - DNA, 543 bp, Homo sapiens
  misc_feature: GZ8MTXP02FHWBZ.19.59.F04.1.454.CMB.2.raw
  modified_base (283)..(283): a, c, t, g, unknown or other
  misc_feature (283)..(283): n is a, c, g, or t
  modified_base (312)..(312): a, c, t, g, unknown or other
  misc_feature (312)..(312): n is a, c, g, or t
  modified_base (475)..(475): a, c, t, g, unknown or other
  misc_feature (475)..(475): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctggtggagtctggggggagcttggtacagcctgggagggtccctgagactctcctgtgcagcatctggattcaccttnagtagttatagaaatgaatttggggtccnccaggctcgaggggaaggggctgggagttggggtttcagtacattagtagtagtggttagtgcatatacctacgcagacttcgtgtggaaggggccgattccaccatcctaccgagacgacaggccgaccaagaactcaactgtactctagacaaatgaaacngcctaggagagcccgaagggaccacgggtctaagtttactaacgtgtacggcgagaggaggtcggacg

SEQ ID NO: 350529 - DNA, 691 bp, Homo sapiens
  misc_feature: GZ8MTXP02I486A.19.59.F04.1.454.CMB.2.raw
  modified_base (169)..(169): a, c, t, g, unknown or other
  misc_feature (169)..(169): n is a, c, g, or t
  modified_base (220)..(220): a, c, t, g, unknown or other
  misc_feature (220)..(220): n is a, c, g, or t
  modified_base (323)..(323): a, c, t, g, unknown or other
  misc_feature (323)..(323): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacaggtcctgggcccagtctgtgtgacgcagccgccctnagtgtctgccggccccaggacagaaggtcaccatctcctgctcgtaggaancacgctaccaaagtagttaggggaattaattttgacgttccgtggtaaccagcacgcctcccgaaggaaccacgacccccctaaactcctacttacgttttanaacctaaagttaaactaaccgaccgtaacccctagaacggttacttacccgtacgaaccgttacttctcgtacggtacctacccgtaacgtcgtcgacctacgtacaccgcccgtaccgtcggcctacgccgtaaccggactccgaaaggtcggacggggacgtacggacgtaagtttactacgacggacggaacagttaggataacgcgacgtctaagtgtaacgtgtacgaaagttagggccggacgggaaacgaacgacgtacgtcgaaaccggtttcgaaacgggccaccggacccgaagtccgtaaccccgtccccgttacggaccctcccggtttcctccccgggtttcccccgtaaacccg

SEQ ID NO: 350530 - DNA, 792 bp, Homo sapiens
  misc_feature: GZ8MTXP02IVRNQ.19.59.F04.1.454.CMB.2.raw
tcagtactctcgtgcacgaccggtgctcgatttagtacacacacttagggattgggggccctagccctggattccaaggcatttccacttggtgatcagcactgaacacagaggactcaccatggagttgggctgtgctggttttccttgttgctatttagaaggtgtccagtgtgaggtgcagcgtggtggagtcggtgggggaggtcgttggtacaggccgtgggacgggtccctggacgtactcctcctgtgcagtcctcgtggtacttcctaccttcagttaagttatagaaatgtaaagtttcgggtcccgaccgtacggtccgtaccggaagggggtaacggggtcgtaggggtagggtttcgggttttacaagttaaccgtaagtttttaggtaggtttaaggttagggttaagtaagtacctaagttaacttacgtaaccgaccgtaagtaccgttcgttaggggtacggaaacgggggtcccttaattacccgaaacctcttaccgacccgaaagaacgaaccacgggacccgtaaacccgtaaaacgtaaccctctaaacgttaggtaaccttcgtaaaccgtaaataaaacgttaacgaaacgaccgtaccgtaggaacgacggacccggaaggaaccgtacggtacgttaagtttaacgttacggtagacggtacggaaagtacgggtacggtaggtaaacggtaaagggtttaacggggaacgggggttccgtaaaacgtttagggtttacggttaagggggtttcgggtttaaagggg

SEQ ID NO: 350531 - DNA, 538 bp, Homo sapiens
  misc_feature: GZ8MTXP02IDFRU.19.59.F04.1.454.CMB.2.raw
  modified_base (233)..(233): a, c, t, g, unknown or other
  misc_feature (233)..(233): n is a, c, g, or t
  modified_base (271)..(271): a, c, t, g, unknown or other
  misc_feature (271)..(271): n is a, c, g, or t
  modified_base (388)..(388): a, c, t, g, unknown or other
  misc_feature (388)..(388): n is a, c, g, or t
  modified_base (432)..(432): a, c, t, g, unknown or other
  misc_feature (432)..(432): n is a, c, g, or t
  modified_base (444)..(444): a, c, t, g, unknown or other
  misc_feature (444)..(444): n is a, c, g, or t
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
  modified_base (467)..(467): a, c, t, g, unknown or other
  misc_feature (467)..(467): n is a, c, g, or t
tcagtactctcgtgcacgaccggtgctcgatttagtacacacacttagggtagttgggggcagctctcagagaggtgccctagccctggattccaaggcatttccacttggtgatcagcactgaacacagaggactcaccatggtagttggggctgtgctgggttttcctgttgctatttagagtgtccagtgtgaggtgcgagctgggtgagtcgtgggggagcttggtacngcctggagggtccctgacgactctcctgtgcagcctcnggattccacttcaggtacgtatgaatgaatttggccgcgaggctcgagggagggctggacgttggttcataccgtattagtagtacgtggtatacgcattatacgtagccagactcngtagacgggaccagttacacctagtacctccagagacctaggcncctaaagaactnacgtntaanctagacaaagaganaagcgagagagaccgagacgaccggacgacgttacgttagtaagtagtacgacgagtaacgtcgagtaagg

SEQ ID NO: 350532 - DNA, 683 bp, Homo sapiens
  misc_feature: GZ8MTXP02HZRXZ.19.59.F04.1.454.CMB.2.raw
  modified_base (481)..(481): a, c, t, g, unknown or other
  misc_feature (481)..(481): n is a, c, g, or t
  modified_base (680)..(680): a, c, t, g, unknown or other
  misc_feature (680)..(680): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgcctcagtgtctgccggcccaggacagaaggtcaccatcctcctgctcgtaggaagcaagctaccaaagagttagggaataattttggtgtccgtggtaccagcagcctccaggaacaccgaccccaaactcctactattttgaactaaataataacgccgaaccctcgagggtacttcctagtaccgtattcctacgtcgtacctaccctaagtctggacctacgtcgacgcccgtaaccgtgggacctacgccgacccggactacccgaacggtacgcgggggaacgcgggaccgtaacgtttaagttacccgnggaccggaaactagtacggggaattacgacgaacggtcccgttagggaagttaccgtagttacggaaacgttaggaccgggacggggaacgggtaccgtaacggacgtaccggtacccgttacgtaaacgggtccaccggacccgaaggcccgttaacccgccccgtacggtccaccgtttccgtcccggtttcccccnccg

SEQ ID NO: 350533 - DNA, 912 bp, Homo sapiens
  misc_feature: GZ8MTXP02F0MBM.19.59.F04.1.454.CMB.2.raw
tcagtactctcgtgcacgaccggtgctcgatttagtacacacacttagggatttggggcagaaggcaggactcgggacaatcttcatcatgacctgctcccctctcctcctcacccttctcattcactgcacagggtcctgggcccagtctgtgttgacgcagcccgccctcagtgtctggccggcccaggacagaacggtcaccatctcctgctcgtaggaagcagcctaccaaactagttaggggaaattaattttggcgttaccgtggtaacccagtcaacgcctacccgaaggaaccaccgaccccctaaaactccctacttattttacgaaactaaataaactaaacgaccgtaaccctacgacgggtactttacccgtacgaaccgtaactttccgtacgttcggtacctaaccccgtaaacgttccgtacggaccgtaaccgttaccgtaaccggtcccccgtaaacccgggtcgggggtaacctaccgttacccgaaacccggggtaaccttacccggaaaacgggaaccggggttaccggggggaaccggtaaccgggggtaacccggtttaaattttaaccgttaacccggttacgggaaacccggggtaaaaccgtaaacgggtaggggtaaacgttaaacggccgtaaaccggttacccgtaaggtaacgggttaccgttaggtaaggtaaacgttaaacggtcgggggaaccgggaaacgggtaaacccgaaaacggtccggtaaccgggtaccccggttaaccggttaaacgggtacccgtaaaccggggtaaccccggaaaaccgggtccccgtaaaccccgggttcccccccgttacggggttacccccgttaccctttacccgtttccccggttttaaccccctaaaccccccgg

SEQ ID NO: 350534 - DNA, 697 bp, Homo sapiens
  misc_feature: GZ8MTXP02JROYO.19.59.F04.1.454.CMB.2.raw
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgccggccccaggacagaaggtcaccatctcctgctctggaacgcagcctaccaagtagttaggggaaattatttttggcgtccgtggtaccagcacgcctcccaaggaaccaccgacccccaaacttcctactattttacgaactaaataaactaacgccgtaccctagaacgggtactttaccgtcgaaccgttacttcgtcgtacggtcctaccccgtaagttctcgggactacgtaccacgccctacccgtcgggacctacgtccgaccggaccttacccgagtaccggtcggggacgacggcccgttaagtttacgttacgacggtacggaaacgtaggttaggggtaactaacggaccgaacggtcccgtaggtaacggttaccgtagtagtaacgtacggtcggggacggacggaacgacgtacgtacgaccggttacgtaggaccgacgacccgaacggtccgtccggtccccgttacggaccctcgttaccgtaccgttcccctaaccccg

SEQ ID NO: 350535 - DNA, 534 bp, Homo sapiens
  misc_feature: GZ8MTXP02I97QL.19.59.F04.1.454.CMB.2.raw
  modified_base (249)..(249): a, c, t, g, unknown or other
  misc_feature (249)..(249): n is a, c, g, or t
  modified_base (416)..(416): a, c, t, g, unknown or other
  misc_feature (416)..(416): n is a, c, g, or t
  modified_base (512)..(512): a, c, t, g, unknown or other
  misc_feature (512)..(512): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaaacattgggaaagtaattttgngtcctggtaccagcagctccaggaacagcccccaaaactcctcattttgacaataataaagcgaccctcagggattcctgaccgtatctctggctcccaagtctgcacgtcagccacctgggcatcacggctccagactggggacaggccgattatactgcgaacanggatagctagcctgagtactgtcgataatcggcggagggaccaagactgaccgtctaggtcacgacccaaggcctaacgcccccgtacggttaccncgttacctcgttccccgtcccc

SEQ ID NO: 350536 - DNA, 663 bp, Homo sapiens
  misc_feature: GZ8MTXP02FMCO1.19.59.F04.1.454.CMB.2.raw
  modified_base (278)..(278): a, c, t, g, unknown or other
  misc_feature (278)..(278): n is a, c, g, or t
  modified_base (399)..(399): a, c, t, g, unknown or other
  misc_feature (399)..(399): n is a, c, g, or t
tcagtactctcgtgcacgaccggtgctcgatttagtacacacacttagggattgggggcagctctcagagaggtgccctagccctggattccaaggcatttccacttggtgatcagcactgaacacagaggactcaccatggagttggggctgtgcttgggttttccttgttgctattttagaaggtgtccagtgtgaggtgcagctgggtggagtcgtgggggaggcgttggtacagcccgtgggacggggtcccctgagaccttctccctggtgcnggccctgtggacttcaccttcgagttattatagaaatgaagtttcggtaccgcgaggcgtccgaaggggagggcgtgggtagttgggtttcattaccgtagttagagtagtaggtaggtanctataatactacgctaagtacctcgtagtacggaacgggtacctagttaccaacccgattcccgaccgaaggacgaaccgcgaccggacctaaaacggaaccttaccgaaccttgggttaactaccttaggaaacctaaaggttaccgaaacgtaccgaccgtaacgggaagacccgggtacccgaaacgggttaccgaaccggtacgttaagtttacctttagcgttaaggccgaaaggacggtcggtaggaacgtaaggggg

SEQ ID NO: 350537 - DNA, 693 bp, Homo sapiens
  misc_feature: GZ8MTXP02IX0P0.19.59.F04.1.454.CMB.2.raw
  modified_base (171)..(171): a, c, t, g, unknown or other
  misc_feature (171)..(171): n is a, c, g, or t
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
tcagtactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctnagtgtctgcgccccaggacagaaggtcaccatctcctgctcgtggaacncagctaccaaanttagggaatattttgngtcctgtacngcagctccaggacacgccccaaactcctaccatttttcgacaaattaaataacgcgtaaccctacgaggggtaactttcccgtagtaacccgtacttacttccgtcggtctaccccgaagttcctcgggacctaccggtccaacgccaacccgttgggaccaacgttaaccccgggacttcccgaaacgtaccgtacgggggaaccacgggacccggtaatttaacgtttaacgttcggaaccggttaaccgagttaacgggaagttacggaacgacggacccgttaggtaacgtaccgttagtacgtaagtaacgttcgggaacgggtacggaaccgaacgtcgtaacgaccgtctacgggtacacgtaccgaacgccgttaccgccccgtcggtacctaacgttccggttccgtacccgtcccgttaaccccg

SEQ ID NO: 350538 - DNA, 583 bp, Homo sapiens
  misc_feature: GZ8MTXP02F7LSI.19.59.F04.1.454.CMB.2.raw
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
tcagtactctcgtgcacgaccggtgctcgattttagtacacacacttagggattgggggcagaaggcaggactcgggacaatcttcatcatgacctgctcccctctcctcctcacccttctcattcactgcacaggtcctgggcccagtctgtgttgacgcagccgcctcagtgtctgcggccccaggacagaaggtcaccatcctcctgctctggaagcagctcaacattgggaanattttgntcctggtaccagcagctcccaggaacacgcccccaaactcctcattttgacaataataagcgacctnaggactttccngaccgattcnctgctccccaagtctaggcacgtcagcccaccgtggcatccacggactccagcgtgggacgaggcctagttactacgtgaccgaatagtacggggaataggactaaggccttagaggtacctggtagactaaggtccggagggacgggaaccaagggtcctggaaacccgttccggtaaaggaccgacggacccgaaaggtcccttcggcccccttacggtccacccgtcgttccgttaccccgtaccccg

SEQ ID NO: 350539 - DNA, 590 bp, Homo sapiens
  misc_feature: GZ8MTXP02HROHC.19.59.F04.1.454.CMB.2.raw
  modified_base (455)..(455): a, c, t, g, unknown or other
  misc_feature (455)..(455): n is a, c, g, or t
  modified_base (463)..(463): a, c, t, g, unknown or other
  misc_feature (463)..(463): n is a, c, g, or t
  modified_base (543)..(543): a, c, t, g, unknown or other
  misc_feature (543)..(543): n is a, c, g, or t
tcagtactctcgtgcacgaccggtgctcgatttagtacacacacttagggattgggggccctagccctggattccaaggcatttccacttggtgatcagcactgaacacagaggactcaccatggagttggggctgtgctgggttttccttgttgctattttagaaggtgtccagtgtgaggtgcagctggtggagtcgtggggggaggcttgggtacagcctggagggtccctgagactctcctgtgcagcctctggattcaccttcagtagttatgaaatgtaattgggtccgccgaggcctccgaggggaaggggctggaggtgggtttcagtactagtttagtagtagtggtagtagcatatactacgcagactcgtgtagaggccgattcaccatcacagacgacagcgaccaaagacctacactgtactcgtagacaaaagtcgaaacncggtaccngaaaggaccggaccggaagggaccgtacggggacctaaggttttaactcgttaggtggacgtaaggaggaccggtacggnaagggttcggaggggtacgtatagtttggtaggttcgggtttaaggg

SEQ ID NO: 350540 - DNA, 555 bp, Homo sapiens
  misc_feature: GZ8MTXP01BSUGT.10.27.C05.1.454.CMB.2.raw
  modified_base (259)..(259): a, c, t, g, unknown or other
  misc_feature (259)..(259): n is a, c, g, or t
  modified_base (284)..(284): a, c, t, g, unknown or other
  misc_feature (284)..(284): n is a, c, g, or t
  modified_base (297)..(297): a, c, t, g, unknown or other
  misc_feature (297)..(297): n is a, c, g, or t
  modified_base (355)..(355): a, c, t, g, unknown or other
  misc_feature (355)..(355): n is a, c, g, or t
  modified_base (417)..(417): a, c, t, g, unknown or other
  misc_feature (417)..(417): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattatacttgtctctgtancaacacgccagacaaacgcccccanactcttgatttangaagtcagtaagcgccctcgtagggtttcagtcgcttctctgcctcaagtctgcaacncgccctcctgacatctctggctcaggctgacgagaggctagaatatactgcagtctcatagngtagagttggtctccttacgtttcgtaagggttttccgggacgggttacgggacccgagggtccgttacggacccgttccgttaaacgtccgaacgtccccgaagggtcccttacccggtcccccgttcgggtaaccc

SEQ ID NO: 350541 - DNA, 529 bp, Homo sapiens
  misc_feature: GZ8MTXP01DL25L.10.27.C05.1.454.CMB.2.raw
  modified_base (286)..(286): a, c, t, g, unknown or other
  misc_feature (286)..(286): n is a, c, g, or t
  modified_base (340)..(340): a, c, t, g, unknown or other
  misc_feature (340)..(340): n is a, c, g, or t
tcagcatagtagtgcacgaccggtgctcgatttagacgcgatcgaagggtttggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcggtcaccatctcctgcactggacccagcactgatgttgggcattataaccttgtctcctggtatcaacaacgcccagacaaagcccccanactcttgatttatgaaagtcagtaagcggccctcgagggtttcagtcgcttccnctgcctccaagtctggccaaacacggcctccctgacaatctctgggctccaggctgacgacgaggctgaaatattaactgcagctacatatgtagatggtgtccttcttcgtaagggttttcggcgggagggacccaggcgtgaccgttcttaaaggtcaagcccaaaggccttcgccccgttcggtcc

SEQ ID NO: 350542 - DNA, 575 bp, Homo sapiens
  misc_feature: GZ8MTXP01EAF23.10.27.C05.1.454.CMB.2.raw
  modified_base (263)..(263): a, c, t, g, unknown or other
  misc_feature (263)..(263): n is a, c, g, or t
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (345)..(345): a, c, t, g, unknown or other
  misc_feature (345)..(345): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcggtcaccatctcctgcactggacccagcactgatgttggcattataaccttgtctcctggtancaacaacgccaagacaaagcccccanactcttgatttangaatcagtaagcggaccctcgtagggtttctagtcgctttccnctgcctacaagtctggcaacacggccctcctgacatctctggctcagctgacgagaggctgaatattaactgcacgtcttacattaacaaccgacccgaggggaccacgtcgtaccgtgtagtaacgttcgggcgggagggttacccgtcgggtccgttacgacccggttacccgtaacgtaccgaacggaccccgtaaacgggcccttccggttccccccgttcccggg

SEQ ID NO: 350543 - DNA, 584 bp, Homo sapiens
  misc_feature: GZ8MTXP01CX23C.10.27.C05.1.454.CMB.2.raw
  modified_base (262)..(262): a, c, t, g, unknown or other
  misc_feature (262)..(262): n is a, c, g, or t
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (322)..(322): a, c, t, g, unknown or other
  misc_feature (322)..(322): n is a, c, g, or t
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctgtancaacaacgcccagacaaacgcccccanactcttgatttangaagtcagtaagcggccctnaggggtttctagtcgcttctctgcctcaagtctggcaaacacggcctccccganaactcnctggctccaggctgacgacgaggctgaatattactgcaggctcatatgtagatggtcgtccttcgttttcgaaagggtttttcgggcgggtaagggacccgtaagggccgtacggtaaccccgttccgttaaacgttcccgaacgggtcccccgaaagggtcccttccggttcccccccgttcgggttaacccgtaaccccg

SEQ ID NO: 350544 - DNA, 532 bp, Homo sapiens
  misc_feature: GZ8MTXP01CAX86.10.27.C05.1.454.CMB.2.raw
  modified_base (330)..(330): a, c, t, g, unknown or other
  misc_feature (330)..(330): n is a, c, g, or t
  modified_base (431)..(431): a, c, t, g, unknown or other
  misc_feature (431)..(431): n is a, c, g, or t
  modified_base (523)..(523): a, c, t, g, unknown or other
  misc_feature (523)..(523): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtccatcaccatctcctgcactcgacccacagttacattgtaataatgaatatgtctctggtaccaacagtacccaggcaaacgcccccaaactgatgatttatgatgtcagtaatcgaccctgagggtttcngatcgtcttcttgcctcaagtctgcacacgcctcctgaccatctcgtcggctccagactgaggtacgagctagattatactgcgagctcacatacagcganaggtcgggttggtcggttcgggccgggggtacacgacgttcgtaaccgtccgttacggttcacgcccagggctccgcccccgttggtaaccncgttccccg

SEQ ID NO: 350545 - DNA, 584 bp, Homo sapiens
  misc_feature: GZ8MTXP01B7ASS.10.27.C05.1.454.CMB.2.raw
  modified_base (260)..(260): a, c, t, g, unknown or other
  misc_feature (260)..(260): n is a, c, g, or t
  modified_base (299)..(299): a, c, t, g, unknown or other
  misc_feature (299)..(299): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataacttgtctctgtancaacaacgccagacaaacgcccccacactcttgatttangaagtcagtaagcggccctcgaggggtttcagtcgcttcctctgcctccaagtctggcaacacggccctccctgacaatctctcgggctccgaggctgaccgacgaggctagaaatattactgacagcttcaattatgtaagattcgggtcgtcccttcgttttaccgtaaaggggttttccgggacgggaacggggtacccgaagggtccttcggaaccccgttccgttaaacggtccgaacgccccgtaaggcccgttcccgccccccgttcgggtaaccccg

SEQ ID NO: 350546 - DNA, 578 bp, Homo sapiens
  misc_feature: GZ8MTXP01EJ9AB.10.27.C05.1.454.CMB.2.raw
  modified_base (323)..(323): a, c, t, g, unknown or other
  misc_feature (323)..(323): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattataaccttgtctcctggtatcaacaacgcccagacaaacgcccccacactcttgatttatgaagtcagtaagcgccctntaggggtttctagtcgcttcctctgcctcagtctggcaacacgcctcctgacatctctggctcagctgacgacgaggctagaatattactgcagtctcatatgtagatggttctccttcgtttaccgaaggggtttttccggacggggttacggggtaacccttagggcctttacggaccccgttccgttaaaggttcccgaacggtccccgaaacggggtcccttccgggtcccccccgttcggggttaacccc

SEQ ID NO: 350547 - DNA, 574 bp, Homo sapiens
  misc_feature: GZ8MTXP01ANBL3.10.27.C05.1.454.CMB.2.raw
  modified_base (264)..(264): a, c, t, g, unknown or other
  misc_feature (264)..(264): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtancaacaacgccagacaaacgcccccacactcttgatttatgaagtcagtaagcgccctcgtaggggtttctagtcgcttcctctgcctccaagtctggcaacgaccggcctccctgacaatctctgggctcaggctgacgacgagctagaatatactgcagctanatangtagatgggtctccttcgtttacgtaagggttttccgggacgggttaggggtacccgacgggtcctacggttacccgttccttaaacggtccacggaaccccgaacgggtccttcccggtccccccgttaacgggttccccg

SEQ ID NO: 350548 - DNA, 539 bp, Homo sapiens
  misc_feature: GZ8MTXP01DUIM7.10.27.C05.1.454.CMB.2.raw
  modified_base (259)..(259): a, c, t, g, unknown or other
  misc_feature (259)..(259): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
tcagcatagtagtgcacgaccggtgctcgatttagacgcgatcgaagggtttgggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattataacttgtctctgtancaacacgccagacaaacgcccccanactctgatttangaagtcagtaagccgccctcaggggtttcagtcgcttctctgcctcaagtctggcaacacggcctccctgacatctctggctcgagctgacgacgagctgaatattactgcagctcatatgtagatgggtctccttctttcgtaagggttttcggcgggttacgggacccgagggtcgtacgttacccgttcgttaacgtcaacggccctaaacgggccttccgtccccgttcggttaacccc

SEQ ID NO: 350549 - DNA, 540 bp, Homo sapiens
  misc_feature: GZ8MTXP01AC0HI.10.27.C05.1.454.CMB.2.raw
  modified_base (261)..(261): a, c, t, g, unknown or other
  misc_feature (261)..(261): n is a, c, g, or t
  modified_base (286)..(286): a, c, t, g, unknown or other
  misc_feature (286)..(286): n is a, c, g, or t
  modified_base (299)..(299): a, c, t, g, unknown or other
  misc_feature (299)..(299): n is a, c, g, or t
tcagcatagtagtgcacgaccggtgctcgatttagacgcgatcgaagggtttgggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctgtancaacacgcccagacaaagcccccanactcttgatttangaagtcagtaagcggccctgaggggtttctagtcgctttcctctgcctccaagtctggcaacacggcctccctgacaatctctggctccagactgacgacgagctagaatatactgcagctcatatgtagattggtcgtccttctttccgaagggttttcggcgggttaggggacccttagggtctcggacccgttccttaacgtcacgccccaagggccttcggtccccccgttggtccc

SEQ ID NO: 350550 - DNA, 530 bp, Homo sapiens
  misc_feature: GZ8MTXP01DOVOF.10.27.C05.1.454.CMB.2.raw
  modified_base (262)..(262): a, c, t, g, unknown or other
  misc_feature (262)..(262): n is a, c, g, or t
  modified_base (287)..(287): a, c, t, g, unknown or other
  misc_feature (287)..(287): n is a, c, g, or t
  modified_base (438)..(438): a, c, t, g, unknown or other
  misc_feature (438)..(438): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattataaccttgtctctgtancaacaacgccagacaaagcccccanactcttgatttatgaagtcagtaagcggccctcgaggggtttcagtcgcttcctctgcctcaagtctggcaacacgcctccctgacatctctggctcgagctgacgacgagctagaatatactgcagtctcatatgtagatggtctccttntttcgtaaagggttttcggcgggttagggaccgaggctcgacccgttcgttaagtcacgcccgaaggccttaccgtccccgttcggtaaccc

SEQ ID NO: 350551 - DNA, 592 bp, Homo sapiens
  misc_feature: GZ8MTXP01AQ1HI.10.27.C05.1.454.CMB.2.raw
  modified_base (243)..(243): a, c, t, g, unknown or other
  misc_feature (243)..(243): n is a, c, g, or t
  modified_base (261)..(261): a, c, t, g, unknown or other
  misc_feature (261)..(261): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (334)..(334): a, c, t, g, unknown or other
  misc_feature (334)..(334): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggcattanaaccttgtctcctggtancaacacgccagacaaagccccanactctgatttangaagtcagtaacgcgcctgagggtttcagtcgcttccnctgcctcaagtctggcacgacggcctccgtgacatctctgggctcgaggctgacgacgagctagaatactacgtgcgtacgtctacgagttacgtgtacgtagttcggtacgtcccgttacgtttacgtaacgggttttccggacggttaacggggtacccttagggtccgttacggttaacccggttccgttaaacggtcccgtaacgggtccccgtaacgggtcccgttccggtaacccccgttgggttaaccccg

SEQ ID NO: 350552 - DNA, 587 bp, Homo sapiens
  misc_feature: GZ8MTXP01B799V.10.27.C05.1.454.CMB.2.raw
  modified_base (259)..(259): a, c, t, g, unknown or other
  misc_feature (259)..(259): n is a, c, g, or t
  modified_base (284)..(284): a, c, t, g, unknown or other
  misc_feature (284)..(284): n is a, c, g, or t
  modified_base (297)..(297): a, c, t, g, unknown or other
  misc_feature (297)..(297): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattatacttgtctctgtancaacacgccagacaaacgcccccanactcttgatttangaagtcagtaagcggtccctcgtagggtttctagtcgcttcctctgcctcaagtctgcacacgcctcctgacatctctggctcagctgacgacgagctagaatatactgcgagtctcatatgtagtagtggtcgtccttcgtttacgtaacgggttttcgggacgggttacggggacccgttagggtaccgtcggttacccggttccgttaaaccggttccgaacccggtaacccccgaaaacgggtcccgttacccgggtccccccccgtttccggggtttaacccccg

SEQ ID NO: 350553 - DNA, 545 bp, Homo sapiens
  misc_feature: GZ8MTXP01B2L6Y.10.27.C05.1.454.CMB.2.raw
  modified_base (263)..(263): a, c, t, g, unknown or other
  misc_feature (263)..(263): n is a, c, g, or t
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (322)..(322): a, c, t, g, unknown or other
  misc_feature (322)..(322): n is a, c, g, or t
  modified_base (340)..(340): a, c, t, g, unknown or other
  misc_feature (340)..(340): n is a, c, g, or t
  modified_base (416)..(416): a, c, t, g, unknown or other
  misc_feature (416)..(416): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctctggtancaacaacgcccagacaaagcccccanactcttgatttangaagtcagtaagcggccctnagggtttcagtcgcttcnctgcctccaagtctggcaaacaccggcctccctgacaatctctgggctcaggctgacgacgagctagaatattacngacagtctactatatagtagtagtgtcgtccttcgtttacgttaagggtttcgggtcgggacgggacgacggtcgtcgttaccgttccgttacgtaacacgaaccgacgcgttccgtcccgttccgtcg

SEQ ID NO: 350554 - DNA, 583 bp, Homo sapiens
  misc_feature: GZ8MTXP01DH6R1.10.27.C05.1.454.CMB.2.raw
  modified_base (262)..(262): a, c, t, g, unknown or other
  misc_feature (262)..(262): n is a, c, g, or t
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
  modified_base (454)..(454): a, c, t, g, unknown or other
  misc_feature (454)..(454): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcacgtcggacccagcatgatgtggctattataccttgtctctgtancaacaacgccagacaaacgccccanactctgatttangaagtcagtacgcgtccctgtagggtttctagtcgtcttcctctcgccctactaagtctacggccaaaccgccggcccttccacgtaactaactctcgtcggctccgaggctgacgacgagctagaatatactgcagtctacattagtagtaagngttcgggtcttccttacggtttacggttaacggggttttcgggacgggacgggtaccgaggtccgtacggttacccgttacttacggtccacgcccgtaacggccttcccgtccccgttcggtaacccg

SEQ ID NO: 350555 - DNA, 581 bp, Homo sapiens
  misc_feature: GZ8MTXP01C35E1.10.27.C05.1.454.CMB.2.raw
  modified_base (259)..(259): a, c, t, g, unknown or other
  misc_feature (259)..(259): n is a, c, g, or t
  modified_base (298)..(298): a, c, t, g, unknown or other
  misc_feature (298)..(298): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggctattatactgtctctgtancaacaacgccagacaaacgcccccacactcttgatttangaagtcaagtaagccggccctcgtaggggtttctagtcgtcttccctctgcctccaagtctggcaacaccggcctcctgacatctctgggctccgaggctgacgacgagctagaatattactgacagtctacatatgtagtagttcggtgtccctttcgtttacgtaaggggttttcgggacgggagggtacccagggtcctcggttacccggttccttaaacggtcccaacggtcccccgaacgggcccccgttcccccgttaacgggttccccttaacccg

SEQ ID NO: 350556 - DNA, 538 bp, Homo sapiens
  misc_feature: GZ8MTXP01DPCPL.10.27.C05.1.454.CMB.2.raw
  modified_base (260)..(260): a, c, t, g, unknown or other
  misc_feature (260)..(260): n is a, c, g, or t
  modified_base (285)..(285): a, c, t, g, unknown or other
  misc_feature (285)..(285): n is a, c, g, or t
  modified_base (336)..(336): a, c, t, g, unknown or other
  misc_feature (336)..(336): n is a, c, g, or t
  modified_base (400)..(400): a, c, t, g, unknown or other
  misc_feature (400)..(400): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattatacttgtctctggtancaacacgccagacaaacgcccccanactcttgatttatgaagtcagtaagcgcctcgagggtttcagtcgcttccnctgcctcaagtctgcacacgcctcctgacatctctggctcgagctgacgtacgaggctagaatnttactgcagctacattatgtagtgttggtcgtacctttcgtttacgtaaagggttttcggacgggttagggaccagggtctcggaccgttccgttaaacgtcgaacgcccaaggtccttccgtcccccgttggttccc

SEQ ID NO: 350557 - DNA, 549 bp, Homo sapiens
  misc_feature: GZ8MTXP01DHVWT.10.27.C05.1.454.CMB.2.raw
  modified_base (289)..(289): a, c, t, g, unknown or other
  misc_feature (289)..(289): n is a, c, g, or t
  modified_base (378)..(378): a, c, t, g, unknown or other
  misc_feature (378)..(378): n is a, c, g, or t
  modified_base (452)..(452): a, c, t, g, unknown or other
  misc_feature (452)..(452): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcggtcaccatctcctgcactggacccagcactgatgttggcattataaccttgtctcctggtatcaacaacgcccagacaaacgcccccanactcttgatttatgaagtcagtaagcggccctcgtaggggtttctagtcgctttcctctcgcctccaagtctggcaacacggccctccngacaatctctgggcctcagactgacgacgaggcagaatattactgcagctacatatgtagagtggtgtcccttntttcgtaagggttttcggcggttacgggaccagggtctcggaccgttccttaaagtccgacgcccgtaacggccttccgtcccccgttggtaacccc

SEQ ID NO: 350558 - DNA, 533 bp, Homo sapiens
  misc_feature: GZ8MTXP01EPEB5.10.27.C05.1.454.CMB.2.raw
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
tcagcatagtagtgcacgaccggtgctcgatttagacgcgatcgaagggtttgggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccanactcttgatttangaagtcagtaagcggcctcaggggtttctagtcgcttcctctgcctccaagtctggcaacacggcctccctgacaatctctgggctccaggctgacgacgaggctgaatattactgcagctacatatgtagatgggtntccttntttcgaaagggttttcgggcgggttagggaccagggcctggacccgttcttaaagtcagccccaagggccttcgcccccttgggtccc

SEQ ID NO: 350559 - DNA, 576 bp, Homo sapiens
  misc_feature: GZ8MTXP01D70W9.10.27.C05.1.454.CMB.2.raw
  modified_base (261)..(261): a, c, t, g, unknown or other
  misc_feature (261)..(261): n is a, c, g, or t
  modified_base (437)..(437): a, c, t, g, unknown or other
  misc_feature (437)..(437): n is a, c, g, or t
  modified_base (447)..(447): a, c, t, g, unknown or other
  misc_feature (447)..(447): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgtcaccatctcctgcactggacccagcactgatgttggctattataacttgtctctgtancaacacgccagacaaacgccccacactcttgtatttatgaagtcagtaagccgccctcgtaggggtttctagtcgtcttcctctcgcctaccaagtctggcaacaccggccctccctagacacttctcgtgggctccgaggctgacgacgaggctagaatattactgacagtctanatatgtaagngttggtcgtccttacgtttacgtaacggggtttcgggcgggagggacccagggtcctacggttacccgttcgttaaacggtccaacggaacccgtaacgggcccttccggtcccccgttcgggttcccc

SEQ ID NO: 350560 - DNA, 595 bp, Homo sapiens
  misc_feature: GZ8MTXP01CRQNZ.10.27.C05.1.454.CMB.2.raw
  modified_base (256)..(256): a, c, t, g, unknown or other
  misc_feature (256)..(256): n is a, c, g, or t
  modified_base (281)..(281): a, c, t, g, unknown or other
  misc_feature (281)..(281): n is a, c, g, or t
  modified_base (294)..(294): a, c, t, g, unknown or other
  misc_feature (294)..(294): n is a, c, g, or t
  modified_base (357)..(357): a, c, t, g, unknown or other
  misc_feature (357)..(357): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcggtcaccatctcctgcactggacccagcactgatgtggcattatacctgtctctgtancaacacgccagacaaacgcccccanactcttgatttangaagtcagtaacgcggccctcgtaggggtttctagtcgtcttcctctgcctcagtctgcaacncgcctcctgacatctctggctcgaggctgacgacgagctagatatactgcagctacatatgtagtagttcggtcgtcccttacgtttaccgttaaacggggtttttccggggacgggttacgggggtaacccgagggggtacccttcgggttaccccggttcccgttaaacggttaacccaccgggtaaccccgaaacggggtcccttacccgggtcccccccgttcgggttaacccc

SEQ ID NO: 350561 - DNA, 580 bp, Homo sapiens
  misc_feature: GZ8MTXP01ENCIG.10.27.C05.1.454.CMB.2.raw
  modified_base (265)..(265): a, c, t, g, unknown or other
  misc_feature (265)..(265): n is a, c, g, or t
  modified_base (293)..(293): a, c, t, g, unknown or other
  misc_feature (293)..(293): n is a, c, g, or t
  modified_base (308)..(308): a, c, t, g, unknown or other
  misc_feature (308)..(308): n is a, c, g, or t
  modified_base (440)..(440): a, c, t, g, unknown or other
  misc_feature (440)..(440): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggctattataaccttgtctcctgtanacaacaacgccaagacaaacgcccccanactcttagtatttangaagtcagtaagccggccctcgtaggggtttctagtcgtcttcctctgccctaccaagtctggccaaacaccgccctcccagacaactctcgtcgggctccgaggctagacgacgaggctagaatattacgnacgagctctaatagtgtagattcggtcgtccttacgtttcgtaaggggtttcggcgggttaacgggaccgaggtcgtacggaccgttcgttaacgtccgacgaacccgaacggtcccttaccgtcccccgttggtaaccc

SEQ ID NO: 350562 - DNA, 563 bp, Homo sapiens
  misc_feature: GZ8MTXP01DQCWD.10.27.C05.1.454.CMB.2.raw
  modified_base (261)..(261): a, c, t, g, unknown or other
  misc_feature (261)..(261): n is a, c, g, or t
  modified_base (300)..(300): a, c, t, g, unknown or other
  misc_feature (300)..(300): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattatacttgtctctgtancaacaacgccagacaaacgccccacactcttagatttangaagtcaagtaagcgcctgtagggtttctagtcgctttcctctgcctccaagtctggcaacaccggccctcctgacaatctctggctcagctgacgagagctagaatattactgacgacgtctcaatagtgtagtagttggtctccttactttacgtaagggttttcggacgggacgggtaccgaggtccgtacggttacccgttccttaaacggtccgacgaacccgtaacggcccttaccgtcccccgttcggtaaccccg

SEQ ID NO: 350563 - DNA, 517 bp, Homo sapiens
  misc_feature: GZ8MTXP01EQGXF.10.27.C05.1.454.CMB.2.raw
  modified_base (306)..(306): a, c, t, g, unknown or other
  misc_feature (306)..(306): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaaacaacgcccaagacaaacgcccccacactcttgatttangaagtcagtaagcggccctcgaggggtttcagtcgcttctctgcctcaagtctggcaacacggcctccctgacaatctctgggctccgaggctgaacgacgaggctgaatattactgcagctcatatgtagatggtgtcctctttcaaggttttcggcggttagggaccaggctgaccgttcttaagtcagccagcttcgccccgttgtcc

SEQ ID NO: 350564 - DNA, 638 bp, Homo sapiens
  misc_feature: GZ8MTXP01CKUWC.10.27.C05.1.454.CMB.2.raw
  modified_base (261)..(261): a, c, t, g, unknown or other
  misc_feature (261)..(261): n is a, c, g, or t
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcacgtggacccagcactgatgtggctattatacttgtctctgtancaacacgccagacaaacgcccccanactctgatttangaagtcagtaagccgccctagtagggtttcagtcgcttcctctagcctcaagtctcgggcaaacgaccggtccctccctagaacctaatcctcgtcgggcctaccgaggctaggacgtacgaggtctagaaattacttacgtgacgtagtctacaagttagtagtaagtagttcggtcgtcccgtttacgttttacggtaaacggggttttccgggacgggggttaacgggacccgttaaacgggtcgttaccggttaaccccggttccgttaacgggttcccaacggaaccccggtaacgggtcccgttaccccggtccccccgttcgggtttaacccc

SEQ ID NO: 350565 - DNA, 568 bp, Homo sapiens
  misc_feature: GZ8MTXP01COJK6.10.27.C05.1.454.CMB.2.raw
  modified_base (261)..(261): a, c, t, g, unknown or other
  misc_feature (261)..(261): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggctattataacttgtctctgtancaacacgccagacaaacgccccacactctgatttatgaagtcaagtagccggtccctcgtaggggtttctagtctcttcctctgcctacaacgtctggcaacaccggcctcctgacaatctctcgggctcgagctgacgacgagctagaatatactgacagtctcatagtagtagtagttcggtacgtcctttcgttacgttaacgggttttcggacgggttacgggtaccacgggtcgtacggttaccgttccttaaacgtcgacgtcccgtaacggtccgttccgtcccccgttcggtaaccccg

SEQ ID NO: 350566 - DNA, 582 bp, Homo sapiens
  misc_feature: GZ8MTXP01B12Q4.10.27.C05.1.454.CMB.2.raw
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
  modified_base (357)..(357): a, c, t, g, unknown or other
  misc_feature (357)..(357): n is a, c, g, or t
  modified_base (374)..(374): a, c, t, g, unknown or other
  misc_feature (374)..(374): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacaacgccagacaaacgccccanactctgatttangaagtcagtaagcgccctcgagggtttctagtcgcttcctctgcctcagtctgcacncgcctcctgacaatctntggctcagctgacgacgagctagaattacttactgacaggtcttacaagttataggtagagttcgggttctcctttcgtttacgttaaagggttttcgggacggggttacgggtaccgagggtcccgtggttaaccccggttcttaaacggttcgaccggtaaccccgtaacgggcccgttccgtaaccccccgttcggttaaccccg

SEQ ID NO: 350567 - DNA, 617 bp, Homo sapiens
  misc_feature: GZ8MTXP01DYCWQ.10.27.C05.1.454.CMB.2.raw
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
  modified_base (318)..(318): a, c, t, g, unknown or other
  misc_feature (318)..(318): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcacgtggacccagcactgatgttggcattataaccttgtctcctggtatcaacaacgccaagacaaacgcccccanactcttgatttangaaagtcaagtaanccggccctgaggggtttcagtcgcttcctctgcctcaagtctggcaacacggcctccctgacaatctcgtggctccaggctgacgacgagcagaatatactgcagctcatatgtagattggtcgtctttacgtttcgtaaagggttttccggcggggttaacggggtacccgttaaagggggtcccttacgggttaaaccccggtttccgttaaaacggttaacccgtaaaaccggtcccccggaaaacgggggttcccttaccccggtccccccccgggtttcggggtttaacccccg

SEQ ID NO: 350568 - DNA, 572 bp, Homo sapiens
  misc_feature: GZ8MTXP01AD5XO.10.27.C05.1.454.CMB.2.raw
  modified_base (264)..(264): a, c, t, g, unknown or other
  misc_feature (264)..(264): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtancaacacgcccagacaaacgcccccacactcttgatttatgaagtcagtaagcgccctcgagggtttcagtcgcttcctctgcctcaagtctgcacacggcctcctgacatctctggctcaggctgacgacgagctagaatattactgcagctcatatgtagatggtgtccttcgtttcgtaagggttttcgggcgggttacggggaccgttagggtaccgtcggttaacccgttccgttaaacgttccgaccggaaccccgtaaacggggtcccgttacccggtcccccccgttccgggtttaacccc

SEQ ID NO: 350569 - DNA, 564 bp, Homo sapiens
  misc_feature: GZ8MTXP01D4NXI.10.27.C05.1.454.CMB.2.raw
  modified_base (263)..(263): a, c, t, g, unknown or other
  misc_feature (263)..(263): n is a, c, g, or t
  modified_base (439)..(439): a, c, t, g, unknown or other
  misc_feature (439)..(439): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtancaacaacgcccagacaaacgcccccacactcttgatttatgaagtcagtaagccggccctcgtaggggtttctagtcgcttcctctgcctcaagtctggcaacacgcctcctgacatctctggctccaggctgacgacgaggctgaatattactgcagctcatatgtagatgggtntaccttgtttccgtaagggttttccgggcgggttaggggacccaagggtctcggttaacccgttccgttaaaggttccgaacgtccccgaaagggtcccttacggtccccccgttgggtaacccc

SEQ ID NO: 350570 - DNA, 531 bp, Homo sapiens
  misc_feature: GZ8MTXP01EDRMI.10.27.C05.1.454.CMB.2.raw
  modified_base (262)..(262): a, c, t, g, unknown or other
  misc_feature (262)..(262): n is a, c, g, or t
  modified_base (361)..(361): a, c, t, g, unknown or other
  misc_feature (361)..(361): n is a, c, g, or t
  modified_base (409)..(409): a, c, t, g, unknown or other
  misc_feature (409)..(409): n is a, c, g, or t
  modified_base (423)..(423): a, c, t, g, unknown or other
  misc_feature (423)..(423): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctctggtancaacacgccagacaaacgcccccacactctgatttatgaagtcagtaagcggccctcgagggtttctagtcgcttcctctgcctccaagtctggcaacnccgcctccctgacatctctggctccaggctgacgacgaggctagaatnttactgcagcctanatatgtagtagtggtctccttacttacgtagggtttcggacgggacggacgaggtctacgacccgttcttaagtcaccgccgacgtccgttccgtccccgttcggtcc

SEQ ID NO: 350571 - DNA, 526 bp, Homo sapiens
  misc_feature: GZ8MTXP01EBL5Z.10.27.C05.1.454.CMB.2.raw
  modified_base (256)..(256): a, c, t, g, unknown or other
  misc_feature (256)..(256): n is a, c, g, or t
  modified_base (307)..(307): a, c, t, g, unknown or other
  misc_feature (307)..(307): n is a, c, g, or t
  modified_base (436)..(436): a, c, t, g, unknown or other
  misc_feature (436)..(436): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggcccagtctgccctgactcagcctgactccgtgtctgggtctcctggacagtcgatcactatctcctgcactggcaccagcagtgacataggtgcttataactatgtcncctggtaccaacaacacccaggccaggcccccagactcatcatttctgatntcagtgatcggtccctttgggtactttctaatcgtctttctcttgccctccaaagtctggcaacgacggtcttccctgaccactctccgggctccacgctgagacgaggctctagttatactgcagctnatacactaccgagggcactctcgttagacttagtcggcggagggccttcgggcctggaacccgtccgtacgttctaacgcccgtaaccgg

SEQ ID NO: 350572 - DNA, 580 bp, Homo sapiens
  misc_feature: GZ8MTXP01AHOMH.10.27.C05.1.454.CMB.2.raw
  modified_base (262)..(262): a, c, t, g, unknown or other
  misc_feature (262)..(262): n is a, c, g, or t
  modified_base (298)..(298): a, c, t, g, unknown or other
  misc_feature (298)..(298): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatggttggctattataacttgtctctgtancaacacgccagacaaacgccccacactctgatttangaagtcagtagcgccctcgagggtttcagtcgtcttcctctcgcctccaagtctggcaaacacggcctccgtgacaatctctgggctcgagctgacgacgaggctagaatatactgcgagctcatatgtagattcggtcgtcctttcgttttacgtaagggggttttccggacgggttacggggtaccagggtccgttacggaaccccggttccttaaacggtcccgaacggccccgtaaacgggtcccgttaccggtcccccccgttaacgggttaacccc

SEQ ID NO: 350573 - DNA, 591 bp, Homo sapiens
  misc_feature: GZ8MTXP01EQ58S.10.27.C05.1.454.CMB.2.raw
  modified_base (288)..(288): a, c, t, g, unknown or other
  misc_feature (288)..(288): n is a, c, g, or t
  modified_base (360)..(360): a, c, t, g, unknown or other
  misc_feature (360)..(360): n is a, c, g, or t
  modified_base (378)..(378): a, c, t, g, unknown or other
  misc_feature (378)..(378): n is a, c, g, or t
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataacttgtctcctggtatcaacaacgccagacaaacgcccccanactctgatttatgaagtcagtaagccggccctgaggggtttcagtcgcttctctgcctcaagtctggcaacncggcctccctgacatctntgggctcaggctgaccgagagctagaaatatactgacagtcctanaatntagtaagtgttggggtctacccctttgtttaccgtaaagggggttttcccgggacgggaagggggaccccgttaagggtcctttagggaacccccgttccgttaaaagggtcccaacggaaccccgaaaggggtcccttaccggtccccccgttcgggttcccc

SEQ ID NO: 350574 - DNA, 558 bp, Homo sapiens
  misc_feature: GZ8MTXP01A96DX.10.27.C05.1.454.CMB.2.raw
  modified_base (259)..(259): a, c, t, g, unknown or other
  misc_feature (259)..(259): n is a, c, g, or t
  modified_base (284)..(284): a, c, t, g, unknown or other
  misc_feature (284)..(284): n is a, c, g, or t
  modified_base (297)..(297): a, c, t, g, unknown or other
  misc_feature (297)..(297): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataacttgtctctgtancaacaacgccagacaaacgccccanactcttgatttangaagtcagtaagccggcctcgtaggggtttcagtcgtcttcctctgcctcaagtctggcaacacggccctcctagacatctcgtggctcgagctgacgacgaggctagaatacttactgcagctacattatgtagagttggtcgtccttacgtttcgtaaggggttttcggacgggttacgggaccgttaggtccgtacggacccgttccgttaacgtccgacgaacccgaacggtccgttcccggtccccgttcggtccc

SEQ ID NO: 350575 - DNA, 604 bp, Homo sapiens
  misc_feature: GZ8MTXP01A7K7W.10.27.C05.1.454.CMB.2.raw
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattatacttgtctctgtancaacacnccagacaaacnccccanactctgatttanagaagtcagtaacgcgccctcgtaggggtttctagtcgcttcctctcgcctacaacgtctacggccaaaccgaccggccctcccgtgaactacttccgtcgtgggcctccgaggcctacggaacggtacgagtcctagaacttagtactgactacgtcgtactagttagtagtagtagttggtctaccttcgtttacggtaggggttttcggcgggacgggtaccgagggtcgtacggttacccggttccttaacggtcgaccggtaacccgaagggtcccttacccggtccccgttccggtaaccc

SEQ ID NO: 350576 - DNA, 658 bp, Homo sapiens
  misc_feature: GZ8MTXP01CBVE3.10.27.C05.1.454.CMB.2.raw
  modified_base (261)..(261): a, c, t, g, unknown or other
  misc_feature (261)..(261): n is a, c, g, or t
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
  modified_base (430)..(430): a, c, t, g, unknown or other
  misc_feature (430)..(430): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattatacttgtctctgtancaacacgccagacaaacgccccanactctgatttangaagtcagtaagcgtccctgtagggtttctagtcgtcttcctctcgcctcaacgtctacggcaacgaccggccctcctagactaactcgtcgtcggctccgaggctcggacgacgacgtctagtaatattacnggcagtctacaattagtaggtaagtgttacgggtaccgttcccgtttacgttttaccggttaacggggttttaacccggggacgggttaaccgggggtaaacccgacgggtacccgtttaacgggttaacccccggttaccgttaaacgggttcccgaaacccgggtaaccccggtaacggggtccccttaccccgggtaacccccccgtttcgggtttaaccccccg

SEQ ID NO: 350577 - DNA, 543 bp, Homo sapiens
  misc_feature: GZ8MTXP01DHJ7G.10.27.C05.1.454.CMB.2.raw
  modified_base (263)..(263): a, c, t, g, unknown or other
  misc_feature (263)..(263): n is a, c, g, or t
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
  modified_base (334)..(334): a, c, t, g, unknown or other
  misc_feature (334)..(334): n is a, c, g, or t
  modified_base (379)..(379): a, c, t, g, unknown or other
  misc_feature (379)..(379): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgtcaccatctcctgcactggacccagcactgatgttggctattataacttgtctcctggtancaacaacgccaagacaaacgccccanactctgtattangaatcagtaacgcgccctgtagggtttcagtcncttcctctgcctcaagtctggcaaacacgccctcccagacatctntcggctccgagctgacgacgagctagaatattangcgntctatatagtgtagtagtgtcgtcttacgttacgttacggttcgggtacgggacggacgacgtcgtacgttaccgttaccgttacgtaacgacgaaccgacgtccgttcccgtcccgttccgtccg

SEQ ID NO: 350578 - DNA, 561 bp, Homo sapiens
  misc_feature: GZ8MTXP01CM4RL.10.27.C05.1.454.CMB.2.raw
  modified_base (240)..(240): a, c, t, g, unknown or other
  misc_feature (240)..(240): n is a, c, g, or t
  modified_base (264)..(264): a, c, t, g, unknown or other
  misc_feature (264)..(264): n is a, c, g, or t
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
  modified_base (364)..(364): a, c, t, g, unknown or other
  misc_feature (364)..(364): n is a, c, g, or t
  modified_base (388)..(388): a, c, t, g, unknown or other
  misc_feature (388)..(388): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggntattataaccttgtctcctggtancaacaacgccagacaaacgcccccacactcttnatttangaagtcagtaagccgtccctcgagggtttctagtcgcttcctctgcctcaagtctggcacncgcctccctgacatctctggctcnggctgacgacgagctagaatnttacngcagctanatatgagtattggtcgtcctttcgtttacgtaaagggttttccgggacgggacgggtaccagggtcctcggttaacccgttccgttaaagtccgaaccgtcccgaacgggtccttccgtaacccccgttcggttaaccc

SEQ ID NO: 350579 - DNA, 573 bp, Homo sapiens
  misc_feature: GZ8MTXP01CEZEG.10.27.C05.1.454.CMB.2.raw
  modified_base (285)..(285): a, c, t, g, unknown or other
  misc_feature (285)..(285): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctctgtatcaacacgccagacaaagcccccanactcttgatttatgaagtcagtaacgcggccctcgtaggggtttctagtcgctttcctctgcctccaagtctggcaacncggcctcccngacaatctctggctccgaggctgacgacgaggctagaatattactgcagtctcattatgtagagttggtcgtccttcgttttacgtaagggttttcgggacgggttaggggacccttagggtccgtggaccccggttaccttaaggtcccaacggccccgtaaagggtcccttaccggcccccccgtttcgggtaaccc

SEQ ID NO: 350580 - DNA, 576 bp, Homo sapiens
  misc_feature: GZ8MTXP01BV61U.10.27.C05.1.454.CMB.2.raw
  modified_base (261)..(261): a, c, t, g, unknown or other
  misc_feature (261)..(261): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataacttgtctctgtancaacaacgccagacaaacgccccacactctgatttatgaagtcagtaagcggccctcgtaggggtttctagtcgtcttcctctgcctcaagtctggcaacncggcctcccngacatctctggctcgagctgacgacgagctagaatattactgcgagtctacatatgtaagtgttcggtctccgtttcgtttcgttaaagggttttcgggacgggttacgggaccgagggtccgttacggttacccgttaccgttaacggttcaccggtcccgtaacgggtcccgttacccgtccccccggtttcggttaacccc

SEQ ID NO: 350581 - DNA, 624 bp, Homo sapiens
  misc_feature: GZ8MTXP01DTG5N.10.27.C05.1.454.CMB.2.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggcccagtctgccctgactcagcctgactccgtgtctgggtctcctggacagtcgatcactatctcctgcactggcaccagcagtgacataggtgcttataactatgtctctgtaccaacaacaccaggccacggccccagactcatctatttctgatgtcagtgtacgtccggtcctttgggtactttactaatcgtcttctcctcgtcctactaagtcctggaccaacacgggtccttccctgtaccctatcccgtccgggtcctacccgacgccgtaggacggacgaacggcttactagtttaacttactcgactagtccttacaacgttaacgtaccacccggtacggggcctacgttaacttcggttagtacgttaacggttccgggcggggttaacgggttccgttcggggccttaccggtaacccggttacccgtaccggttaccgtaaccggaaccccggtaaccgggg

SEQ ID NO: 350582 - DNA, 519 bp, Homo sapiens
  misc_feature: GZ8MTXP01EWW9C.10.27.C05.1.454.CMB.2.raw
  modified_base (292)..(292): a, c, t, g, unknown or other
  misc_feature (292)..(292): n is a, c, g, or t
  modified_base (408)..(408): a, c, t, g, unknown or other
  misc_feature (408)..(408): n is a, c, g, or t
  modified_base (448)..(448): a, c, t, g, unknown or other
  misc_feature (448)..(448): n is a, c, g, or t
  modified_base (504)..(504): a, c, t, g, unknown or other
  misc_feature (504)..(504): n is a, c, g, or t
tcagcatagtagtgcacgaccggtgctcgatttagacgcgatcgaagggtttggggggggtcacaagaggcagcgctctcgggacgcctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctgtatcaacaacgcccaagacaaacgcccccanactcttgatttatgaagtcagtaacgcggccctgtagggggtttctagtcgcttcctctgcctcaagtctgcacacgcctcctgacatctctggctcaggctgacgacgagcgtanaatattactgcgagctacatatgtagtagtggtgtccttntttcgtaagggtttcgcggagggcaggctgaccgttcttaacgtcacgccaaggcncgtccccgttgtccc

SEQ ID NO: 350583 - DNA, 539 bp, Homo sapiens
  misc_feature: GZ8MTXP01B25HP.10.27.C05.1.454.CMB.2.raw
  modified_base (304)..(304): a, c, t, g, unknown or other
  misc_feature (304)..(304): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaacgcccccacactcttgatttangaagtcagtaagcggccctgagggtttctagtcgcttcctctgccctcaagtctggcaacacggccctccctgacaatctctggctcgagctgacgacgagctagaatattactgcgagctcatatgtagatggtctccttctttcgtaagggtttcggcgggttagggccagggtcgtcgttacccgttccttagtccgacgcccgaggccttccgtcccccgttcggtaaccc

SEQ ID NO: 350584 - DNA, 601 bp, Homo sapiens
  misc_feature: GZ8MTXP01C3FQY.10.27.C05.1.454.CMB.2.raw
  modified_base (267)..(267): a, c, t, g, unknown or other
  misc_feature (267)..(267): n is a, c, g, or t
  modified_base (306)..(306): a, c, t, g, unknown or other
  misc_feature (306)..(306): n is a, c, g, or t
  modified_base (443)..(443): a, c, t, g, unknown or other
  misc_feature (443)..(443): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggctattactaaccttgtctcctggtancaacaacgccagacaaacgcccccacactcttgatttangaagtcagtaacgcggtccctgtagggtttcagtcgtcttcctctgccctacaagtctggccaaacacggccctaccctgacctaatcctctcgggctccgaggctagacgacgaggctagaatatactgacagtcnctatataggtagagttcggtacgtcctttactttcggtaaagggttttccgggagggacggggaccgttacgggtaccgtacggttacccgttccgttaaacgggtccaaccggccccgtaacgggtccttcccgggtcccccgttcgggttaacccc

SEQ ID NO: 350585 - DNA, 562 bp, Homo sapiens
  misc_feature: GZ8MTXP01C4P7X.10.27.C05.1.454.CMB.2.raw
  modified_base (285)..(285): a, c, t, g, unknown or other
  misc_feature (285)..(285): n is a, c, g, or t
  modified_base (298)..(298): a, c, t, g, unknown or other
  misc_feature (298)..(298): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggcattataaccttgtctctgtatcaacacgccagacaaacgcccccanactcttgatttangaagtcagtaagccggtcctcgagggtttcagtcgcttcctctgcctccaagtctggcaaacaccggccctcctgactaatctctgggctccgaaggctaggacgtacgaggtctagaaattattaactggctacgcttaccaattatgtagaagtggtgtcccttgtttacgtaagggttttcgggacggttacgggaccgaggtctggttacccggttcttaacgtccgagtcccaaggtccttcgtccccgttgggttccc

SEQ ID NO: 350586 - DNA, 606 bp, Homo sapiens
  misc_feature: GZ8MTXP01EBRLI.10.27.C05.1.454.CMB.2.raw
  modified_base (261)..(261): a, c, t, g, unknown or other
  misc_feature (261)..(261): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtcgtggtctcctggacagtcgtcaccatctctgcactggacccagcactgatgttggctattactaacttgtctctgtancaacacgccagacaaacgccccacactcttagatttatagaatcagtaagccggccctcgtagggtttctagtcgtcttcctctcgcctccaagtctcgggccaaaccgaccggccctccctgaaccaatcctcgtgggcctccgaggctggacgacgagctagaaatacttaactcgacagtctactaatagtgtaagagttgggtctcccgtttacgtttacggtaaacgggttttccgggacggggttaggtaacccgttaaggccgttacggaacccgttcccgttaagtccgaacgaaccccgtaacggcccgttcccgtcccccggttcggttaacccc

SEQ ID NO: 350587 - DNA, 572 bp, Homo sapiens
  misc_feature: GZ8MTXP01BZI6D.10.27.C05.1.454.CMB.2.raw
  modified_base (260)..(260): a, c, t, g, unknown or other
  misc_feature (260)..(260): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (399)..(399): a, c, t, g, unknown or other
  misc_feature (399)..(399): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattatacttgtctctgtancaacacgccagacaaacgccccanactctgatttangaagtcagtagccggcctcgtagggtttctagtcgtcttcctctgccctccaagtcctggccaacaccggccctccctagaactaactctcgtgggcctacgnggctagacgacgaggtctagaatattactgcagtctacatatgtagtagtggtcgtccttcgtttacgtaaagggttttcggacgggttacgggaccgaggtccgtcgttacccgttacgttaacgtcgaccggtcccgtaagggtccttcccgtcccccgttcggtaacccc

SEQ ID NO: 350588 - DNA, 557 bp, Homo sapiens
  misc_feature: GZ8MTXP01D9UYP.10.27.C05.1.454.CMB.2.raw
  modified_base (263)..(263): a, c, t, g, unknown or other
  misc_feature (263)..(263): n is a, c, g, or t
  modified_base (289)..(289): a, c, t, g, unknown or other
  misc_feature (289)..(289): n is a, c, g, or t
  modified_base (372)..(372): a, c, t, g, unknown or other
  misc_feature (372)..(372): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattataacttgtctcctgtancaacaacgccagacaaacgcccccanactcttgatttatgaatcagtaagccgccctcgtaggggtttctagtcgtcttcctctgcctcaagtctgcaacacgcctccngacatctctggctcagctgacgacgagctagaatatactgcagctacatatgtagtagttggtcgtccttagtttcgtaaagggttttcggcgggacgggtacccgaggtccgtacggacccgttcgttaaacgtccacggaaccccgtaacggtcccgttccgtccccccgttgggtaaccccg

SEQ ID NO: 350589 - DNA, 619 bp, Homo sapiens
  misc_feature: GZ8MTXP01C7XJM.10.27.C05.1.454.CMB.2.raw
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcggtcaccatctcctgcactggaccagcactgatgtggctattactactgtctctgtancaacacncanacaacnccccanctctgattanagatcagtagcgccgtgtagggtttctagtcgtcttcctctcgccctaccaacgtccgttcggaaccaaaccgacccgggtccctaccccgtacgaacctaaactcctcgttcgggccttaccgacggctacggaaaccggaccggaagggtctaagaacttattaaccgtgacgtacgtctactaagttagttgtaagtagttcggtcgtaccgtttacgtttacggttacggggtttaacgggcggttacgggtacgaacggtctacggttacccgttcgttaacgtccgacgcccgacggccttacccgtccccgttcgtaacccc

SEQ ID NO: 350590 - DNA, 597 bp, Homo sapiens
  misc_feature: GZ8MTXP01A02ED.10.27.C05.1.454.CMB.2.raw
  modified_base (217)..(217): a, c, t, g, unknown or other
  misc_feature (217)..(217): n is a, c, g, or t
  modified_base (303)..(303): a, c, t, g, unknown or other
  misc_feature (303)..(303): n is a, c, g, or t
  modified_base (319)..(319): a, c, t, g, unknown or other
  misc_feature (319)..(319): n is a, c, g, or t
  modified_base (381)..(381): a, c, t, g, unknown or other
  misc_feature (381)..(381): n is a, c, g, or t
  modified_base (389)..(389): a, c, t, g, unknown or other
  misc_feature (389)..(389): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgtcaccatctctccgnactggacccagcatgattggtggctatttactaaccttgtctccgtggtatacaaacaaccgcccaagaaccaaacgccccccaanactcttagtactttangaagtcaagtaacgccggtccctgtagggtttctagtcgtcttctctgcctcagtctgcacncgcctccngacatctcgtggctcgagctagacgacgagtctagtaactattacgtgacgtagtctactagtagtgtagtagtcggtctccgtttacgttacggttacgggtttcgggacgggttacggtaccgttacggtccgtacggttacccgttacgttaacgtccgaccgaacccgtaacggtcccttacccgtccccgttcggttaacccc

SEQ ID NO: 350591 - DNA, 566 bp, Homo sapiens
  misc_feature: GZ8MTXP01EER9V.10.27.C05.1.454.CMB.2.raw
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (285)..(285): a, c, t, g, unknown or other
  misc_feature (285)..(285): n is a, c, g, or t
  modified_base (298)..(298): a, c, t, g, unknown or other
  misc_feature (298)..(298): n is a, c, g, or t
tcagcatagtagtgcacgaccggtgctcgattttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcatgatgtggctattanaccttgctctgtancaacaacgccagaccaaagccccanactcttgatttangaagtcagtaagccgcctgagggtttcctagtcgcttcctctgcctcaagtctggcaacacgcctccctgacaatctctggcacgagctgacgacgagctagaatataatcgacgatctatagtatgtagtagttgtcgtccgtttacgtttacggtaacgggtttcgggacgggttacgggtaccgttacggtccgtacgttacccgttacgttaacggtccgtaccgaacccgtacggtcccgttcccgtcccccgttccggtccc

SEQ ID NO: 350592 - DNA, 561 bp, Homo sapiens
  misc_feature: GZ8MTXP01C1KE4.10.27.C05.1.454.CMB.2.raw
  modified_base (485)..(485): a, c, t, g, unknown or other
  misc_feature (485)..(485): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcccggacagtcggtcaccatctcctgcactggacccagcactgatgttggcattataaccttgtctcctggtatcaacaacgcccagacaaacgcccccacactcttgatttatgaagtcagtaacgcggcccttcgagggggtttctagtcgcttctcctgcctcaagtctaggcaacacggccctccctgacatctcgtgggctccgaggctagacgacgagctagaattatactgcaggctacatatgtagagttcggtctccttctttacgtaacgggttttcggaacgggngggacctgggcgtcggaacccgttacgttaagttccaacggacccaagggtcctcggccccctggttcctaacccg

SEQ ID NO: 350593 - DNA, 600 bp, Homo sapiens
  misc_feature: GZ8MTXP01CG1NQ.10.27.C05.1.454.CMB.2.raw
  modified_base (262)..(262): a, c, t, g, unknown or other
  misc_feature (262)..(262): n is a, c, g, or t
  modified_base (302)..(302): a, c, t, g, unknown or other
  misc_feature (302)..(302): n is a, c, g, or t
  modified_base (436)..(436): a, c, t, g, unknown or other
  misc_feature (436)..(436): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgtcaccatctcctgcactggacccagcactgatgttggctattataaccttgtctcctggtancaaacaacgccaagacaaacgccccatactcttgatttanacgaagtcaagtaacgccggtccctacgtagggtttcacgtcgctttcctctgcctcaagtctggcaacgacggccctcccctagactaatctcgtcgggctccgaggctaggacacgaggctagaatattacngcgagtctacatatgtacgtagttcgtcgtcctttacgttacgttaacgggtttcgggacggttacgggaccgttaggtaccgtacggttaacccgttccgttaaacgtaaccgaaccgtaaccccgtaacggtcccgttacccggtcccccgttcggtaaccc

SEQ ID NO: 350594 - DNA, 547 bp, Homo sapiens
  misc_feature: GZ8MTXP01CAO1L.10.27.C05.1.454.CMB.2.raw
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
  modified_base (324)..(324): a, c, t, g, unknown or other
  misc_feature (324)..(324): n is a, c, g, or t
  modified_base (419)..(419): a, c, t, g, unknown or other
  misc_feature (419)..(419): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccanactcttgatttangaagtcagtaagcggccctnaggggtttctagtcgcttcctctgcctccaagtctggcaaacacggcctccctgacaatctctggctcagctgacagagctgaatatactgcganctcatatgtagagtggtcgtccttcgtttacgttaagggtttaacgggtacgggacgggacgacggtacgtcgttaccgttaccgttaacgtaacacgaaccgacgcgttccgtccccgttccgtccg

SEQ ID NO: 350595 - DNA, 724 bp, Homo sapiens
  misc_feature: GZ8MTXP01CVWTI.10.27.C05.1.454.CMB.2.raw
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggacccagcactgagttggttggactattataaccttgtctcctggtancaacaacgccaagaacaaacgccccanactcttagtatttatagacgtacagtaacgccgtcctcgtagggtttctagtcgtcttccctctcgtcctaccgaacgttccgtacgggaacctaaacccgacccgggtaccccttaccctacggaacctaaacgttcccgtcgttccggggaccttacccgagggtacccttaacgggaacggaaccgggtaagggtcctaaggtaaactttacgttacgtcgacgtaacgtccgttataattaaggttgtaagttagttcggggttcctcccgttttacgtttaaccggttaacgggggttttccgggaacggggttacggggtacccgaggggttccctacgggttaaccccgttcgttaaacggttccgaaccggtaacccgtaacgggcccgttaccccgtcccccggttaacgggttcccc

SEQ ID NO: 350596 - DNA, 594 bp, Homo sapiens
  misc_feature: GZ8MTXP01DK1DU.10.27.C05.1.454.CMB.2.raw
  modified_base (198)..(198): a, c, t, g, unknown or other
  misc_feature (198)..(198): n is a, c, g, or t
  modified_base (260)..(260): a, c, t, g, unknown or other
  misc_feature (260)..(260): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (342)..(342): a, c, t, g, unknown or other
  misc_feature (342)..(342): n is a, c, g, or t
  modified_base (412)..(412): a, c, t, g, unknown or other
  misc_feature (412)..(412): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacngtcggtcaccatctcctgcactggacccagcactgatgtggcattatacttgtctctggtancaacacgccagacaaacgccccanactctgatttangaagtcagtaacgccggtccctcgtagggtttctagtcgtcttccnctgcctcaagtctggcacacgcctcctgacatctctggctcgagctgacgacggagctagtaatattacngcaagtcttacaattagtgtaagtagttgggtctcccgtttacgtttacggtaaacggggtttttccgggacggggttacggggtacccgagggtcccgttacgttaccccgttcgttaaacggttccgaacggtccccgtaacgggtccgttaccccggtcccccgttcgggttaaccccg

SEQ ID NO: 350597 - DNA, 561 bp, Homo sapiens
  misc_feature: GZ8MTXP01BSKYT.10.27.C05.1.454.CMB.2.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattataaccttgtctcctggtatcaacaacgccaagacaaacgcccccacactcttgatttatgaagtacagtaagccggccctcgtaggggtttctagtcgtcttccctctgcctcaagtctggcacacggccctccctagactaatctctgggctccaggctgaacgacgagctagaactatactgcagctcagtatgtagtagtggtctccgttagtttacgaagggttttcgggcggacgggtaccgaaggtcgtcgacccgttcttaacgtcgaccgtcccgaacggtccttccgcccccgttcggtaaccccg

SEQ ID NO: 350598 - DNA, 763 bp, Homo sapiens
  misc_feature: GZ8MTXP01DDHJ6.10.27.C05.1.454.CMB.2.raw
  modified_base (262)..(262): a, c, t, g, unknown or other
  misc_feature (262)..(262): n is a, c, g, or t
  modified_base (269)..(269): a, c, t, g, unknown or other
  misc_feature (269)..(269): n is a, c, g, or t
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
  modified_base (298)..(298): a, c, t, g, unknown or other
  misc_feature (298)..(298): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcggtcaccatctcctgcactggacccagcactgattgttggctattactacttgtctctgtancaacacnccanacaacnccccanactctgtatttangaagtcagtaacgccggtcctcgtaggggtttctagtcgtctttccctctcgtcctacccgtaacgtccgttacggaaccaaaccgtaccccgggtccccttaccccgtacgaacctaaacgtcccgttcggttacgggtcccttaccgacgggtcctaacgggaaccggacgggtacgggtacttaacgtaaaacttaacgtttaaccgtcggtactaacggtcttaaccgtaattaagtttaccggtaagttaacggttcgggtttccctacccgtttttaccggtttaaccgggtttaaacgggggtttttccccggggaacggggaaccgggggtaaccccgttagggttacccgttaccggttaaccccggtttaccggttaaaaccggttaacccgaaccggtaaccccggtaaaacggtcccccgttaccccggtccccccgttcggggttaaccccc

SEQ ID NO: 350599 - DNA, 550 bp, Homo sapiens
  misc_feature: GZ8MTXP01AVXFH.10.27.C05.1.454.CMB.2.raw
  modified_base (262)..(262): a, c, t, g, unknown or other
  misc_feature (262)..(262): n is a, c, g, or t
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctgtancaacacgccaagacaaacgccccanactcttgatttangaatcagtaagcgcctgagggtttcagtcgtcttcctctgcctccaagtctgcaacacgccctccctgacaatctcgtggctcgaggctgacgacgaggctagaatagttactagcagtctacatatgtagagttggtctccttacgtttcgtaaagggttttcggacgggttacgggtaccgaggtctacggacccgttcgttaaacgtccacgccccgaaaggccgttccgtcccccgttggtaaccc

SEQ ID NO: 350600 - DNA, 734 bp, Homo sapiens
  misc_feature: GZ8MTXP01AGKH3.10.27.C05.1.454.CMB.2.raw
  modified_base (261)..(261): a, c, t, g, unknown or other
  misc_feature (261)..(261): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcgtcaccatctcctgcactggacccagcactgatgttggctattataaccttgtctcctgtancaacaacgccaagacaaacgcccccatactcttgactttatagtaagtcagtaacgccggtccctagtacgggggttttctaggtcgtcctttcctccgttcgcccgttacccaaagttccgtcggtccgaaaccgtcccgggtacccttccccgttaggacctaaactttcccgttcgttcggggacccttaccggagggtcccgttaggaaccggtaccggagggtcccttaggaaattacttaaccgttcggactaacgcctttaccaagtttacgtgttacggtacgtttggggtccttacccttacgtttttacggtaaggggtttttaaccgggcggggaaacggggttacccgaacgggttcccgtaacggttaaccccggttaccgtttaaaacggtcccgtaaccggaaccccgtaaacgggtccccttaccccgggtaaccccccgtttcgggttaacccccg

SEQ ID NO: 350601 - DNA, 603 bp, Homo sapiens
  misc_feature: GZ8MTXP01CUC3L.10.27.C05.1.454.CMB.2.raw
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
  modified_base (476)..(476): a, c, t, g, unknown or other
  misc_feature (476)..(476): n is a, c, g, or t
tcagcatagtagtgcacgaccggtgctcgatttagacgcgatcgaagggtttggggagggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcggtcaccatctcctgcactggacccagcactgatgttggcattataaccttgtctcctggtatcaacaacgcccagaccaaacgccccanactcttgatttanagtaagtcaggttaacgccggccctcgtagggggtttctacgttcgtccctttcctcgtcgtccctccgtaaaagttcctcgggacctaaacccgacccgggtcccctcccctagacctaacttcctcgtcgggccttccgaggcgtacgacgacgagggctagaatattacnggcaggtctacgtatagtgtagtagtgtcgtccttcgttacgtaagggtttcgggcggtagggaccgtaggtcttacggaccttcgtaacgtcgaacgtacccaggttccctccggccccgttccgg

SEQ ID NO: 350602 - DNA, 527 bp, Homo sapiens
  misc_feature: GZ8MTXP01A0INP.10.27.C05.1.454.CMB.2.raw
  modified_base (263)..(263): a, c, t, g, unknown or other
  misc_feature (263)..(263): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtancaacaacgcccagacaaacgcccccacactcttgatttatgaagtcagtaagcgccctcgaggggtttctagtcgcttcctctgcctcaagtctggcacacgcctcctgacaatctctggctcaggctgacgacgagctgaatatactgcagctcatatgtagagttggtgtccttctttcgaaagggttttcgggcgggttggggacccaggcgtcgaccgttcttacgtcacgtcccgaacggcttcgtccccgttcggtcc

SEQ ID NO: 350603 - DNA, 588 bp, Homo sapiens
  misc_feature: GZ8MTXP01B5Q5D.10.27.C05.1.454.CMB.2.raw
  modified_base (260)..(260): a, c, t, g, unknown or other
  misc_feature (260)..(260): n is a, c, g, or t
  modified_base (285)..(285): a, c, t, g, unknown or other
  misc_feature (285)..(285): n is a, c, g, or t
  modified_base (360)..(360): a, c, t, g, unknown or other
  misc_feature (360)..(360): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggcattataacttgtctctgtancaacacgccagacaaacgcccccanactctgatttatgaatcagtaagccgcctcgtagggtttctagtcgtcttccctctgcctccaagtctcgcaacnccggccctccctagacatccgtcgtcgggcctccgaggtctggaacgacggacggtctagaaatattactgacgagtctacatagtgtagtagttcggtctccgttacgtttacggtaacgggttttcgggacgggttacgggtaccgacggtccgtacggaccccgttccgttaaacgtccgaccgcccgtaacggtccgttccccgtcccccgttcggtaaccccg

SEQ ID NO: 350604 - DNA, 723 bp, Homo sapiens
  misc_feature: GZ8MTXP01D7VHK.10.27.C05.1.454.CMB.2.raw
  modified_base (263)..(263): a, c, t, g, unknown or other
  misc_feature (263)..(263): n is a, c, g, or t
  modified_base (699)..(699): a, c, t, g, unknown or other
  misc_feature (699)..(699): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcggtcaccatctcctgcactggacccagcactgatggttggactattataccttgtctctgtancaaacacgccaagaccaaacgccccacacttacttagtattttagagtaacgttacaaggttaacggccccgggttacccgttacggttagggggttttcctacggtccgtcctttcctccgtacgtccccttaccgtaaacgttcccgtacggtaacccaaaccgtaccccgggtccccttccccgtaacggaacttaaaccgttccgttccggtcggggtacccttacccgggaacggtccgttacgggaaaccggaacggtaacgggtcctaaggtaaacttacgttaacttcggaccgtaagtccttactaagttagtaggtagtacgttagggttcctaccgtttacgtttaacgggtaacggggtttaacggcggggttacggaccgttaggtcgtacgttaccgttcttaacgaaccgacgccggtacnccgttaccctcccgttcgtaaccc

SEQ ID NO: 350605 - DNA, 534 bp, Homo sapiens
  misc_feature: GZ8MTXP01BOZBP.10.27.C05.1.454.CMB.2.raw
  modified_base (260)..(260): a, c, t, g, unknown or other
  misc_feature (260)..(260): n is a, c, g, or t
  modified_base (286)..(286): a, c, t, g, unknown or other
  misc_feature (286)..(286): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgtcaccatctcctgcactggacccagcactgatgttggcattataaccttgtctctgtancaacaacgccagacaaacgcccccanactcttgatttatgaagtcagtaagccggccctcgagggtttctagtcgtcttcctctgccctccaagtctggcaaacaccggccctccctgacaatctctgggctcgaggctgacgacgaggctgaaatattactgcagtctacatactaccgacccgagggctactcgtcgtgataagttcggcggtacgggccgtgggcttcggcccgttcctaacgtcgaacgcccaggcctccgccccgtcgg

SEQ ID NO: 350606 - DNA, 732 bp, Homo sapiens
  misc_feature: GZ8MTXP01ERKGC.10.27.C05.1.454.CMB.2.raw
  modified_base (267)..(267): a, c, t, g, unknown or other
  misc_feature (267)..(267): n is a, c, g, or t
  modified_base (295)..(295): a, c, t, g, unknown or other
  misc_feature (295)..(295): n is a, c, g, or t
  modified_base (308)..(308): a, c, t, g, unknown or other
  misc_feature (308)..(308): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatggttgggctaatttataaccttgtctctgtanacaacaacgccaagacaaacgcccccanactcttgatttangaagtcaagtaacgccggtccctagtagggtttctacgtccgtctttccctctcgtccctaccgtaagttccgtcgggaaccaaaccgacccgggtccccttacccgtacgaacctaacttccctcgtcggggtccttcccggaacgggtccgttacgggaaaccggaccggtaagggtaccgtaaggtaaacttaacgttaaccgtcgaccggtaacgtaccttactaagttaagttggtaacgttaggttcgggttccgttacccgttttacgtttacggttaaacgggggttttccgggaacggggttaacggggtacccgttagggtccgtacggttaacccggttccgttaaacggtcccgaaccggtaaccccgtaacgggtccccgttacccggtccccccgtttccgggtaacccc

SEQ ID NO: 350607 - DNA, 579 bp, Homo sapiens
  misc_feature: GZ8MTXP01AZVJV.10.27.C05.1.454.CMB.2.raw
  modified_base (261)..(261): a, c, t, g, unknown or other
  misc_feature (261)..(261): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattataacttgtctctgtancaacacgccagacaaacgccccacactctgtatttatgaagtcagtaacgcggccctcgtaggggtttctagtcgcttcctctgcctcaagtctggcacacggcctcctgacatctcgtggctcgaggctgacgacgagtctagaattattactgcgagtctacaattatcggtagtagtcgggttctcccttcgttttaccgtaagggttttccggggagggttacgggtacccgagggtccgtacggaccccgttcgttaacggtcaccggccccgtaaacgggccttcccggtaaccccccgttgggttaacccc

SEQ ID NO: 350608 - DNA, 585 bp, Homo sapiens
  misc_feature: GZ8MTXP01D4QL0.10.27.C05.1.454.CMB.2.raw
  modified_base (292)..(292): a, c, t, g, unknown or other
  misc_feature (292)..(292): n is a, c, g, or t
  modified_base (366)..(366): a, c, t, g, unknown or other
  misc_feature (366)..(366): n is a, c, g, or t
  modified_base (392)..(392): a, c, t, g, unknown or other
  misc_feature (392)..(392): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacaacgcccaagacaaacgcccccanactctagtatttatgaagtcagtaagccgcctcgtaggggtttctagtcgcttcctctgcctcagtctgcaacncgcctcctgactatctcgtggctcgngctgacgacgaggctagaactatacgtgacgtagcttacattagtagtagagttcggtctcccgtttactttaccggtaaaggggttttcgggacgggttaacggggaccagggtccgtaacggacccgttccgttaaacggttcaaccggaacccgtaacgggccttcccggcccccgtttgggttaacccc

SEQ ID NO: 350609 - DNA, 620 bp, Homo sapiens
  misc_feature: GZ8MTXP01BPFYH.10.27.C05.1.454.CMB.2.raw
  modified_base (262)..(262): a, c, t, g, unknown or other
  misc_feature (262)..(262): n is a, c, g, or t
  modified_base (301)..(301): a, c, t, g, unknown or other
  misc_feature (301)..(301): n is a, c, g, or t
  modified_base (369)..(369): a, c, t, g, unknown or other
  misc_feature (369)..(369): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgtcaccatctcctgcactggacccagcactgatgttggctattataaccttgtctctgtancaacacgccagacaaacgccccacactcttagtatttangaagtacaggtaacgccggtcctcgtaggggtttctagtcgtcttcctctgcctacagtctggcaacnccggcctcctgacatctgtcggcctcgagctgacggacgagctagaatattactgacgagtctactagttaagtgtagtagttcggttcgttacccgtttacgttttacggttaaacggggttttccggggaacggggttacgggtaaacccggttggtacccggttacggttaacccgtttaccgttaaacggttaaccaccggtaacccgaacggtccggttccccgtcccccccgtttgggttccccg

SEQ ID NO: 350610 - DNA, 564 bp, Homo sapiens
  misc_feature: GZ8MTXP01CRGWH.10.27.C05.1.454.CMB.2.raw
  modified_base (261)..(261): a, c, t, g, unknown or other
  misc_feature (261)..(261): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataacctgtctctggtancaacacgccagacaaagccccanactctgatttangaagtcagtaagcggccctgtaggggtttctagtcgtcttcctctgcctcaagtctggcaacacgcctcctgacatctctggctcgagctgacgacgagctagaatattactgacagtctcatacgtgtagtagtggtcgtccctttcgtttacgtaagggttttccggacgggttagggtacccagggtccgtcggttaacccgttccgttaaacgtccgacgtccccgaacggtcccgttacccggtcccccgttcggttaacccc

SEQ ID NO: 350611 - DNA, 566 bp, Homo sapiens
  misc_feature: GZ8MTXP01AR53Q.10.27.C05.1.454.CMB.2.raw
  modified_base (296)..(296): a, c, t, g, unknown or other
  misc_feature (296)..(296): n is a, c, g, or t
  modified_base (308)..(308): a, c, t, g, unknown or other
  misc_feature (308)..(308): n is a, c, g, or t
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
tcagcatagtagtgcacgaccggtgctcgatttagacgcgatcgaagggtttgggggctggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcggtcaccatctcctgcactggacccagcactgatggttgggacattataaccttgtctcctggtatcaacaacgcccagacaaacgcccccanactctgatttangaagtcagtaacgcggccctgtaggggttctagtccgtcttctctgccctacagtctgcaacncgccctcganacactcgtcgtcgctcgcgcgtcgacgagacgtctagtaattacgtcgtcgacagtctacagtatagagttgtcggtcttcccgtttagtttaacggttaacgggtttcggacggggttacggaccgtcgttcgttcgttacccgtgtacgtcgaccgtaccgaccgtccgttcccgtaaccccg

SEQ ID NO: 350612 - DNA, 551 bp, Homo sapiens
  misc_feature: GZ8MTXP01BGXVO.10.27.C05.1.454.CMB.2.raw
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
  modified_base (401)..(401): a, c, t, g, unknown or other
  misc_feature (401)..(401): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggctattataaccttgtctcctggtatcaacaacgccagacaaacgcccccanactcttgatttangaagtcagtaagcggccctcgtagggtttctagtcgcttcctctgcctcagtctgcacacggcctcctgacatctctggctcgaggctgacgacgngctagaatatactgcagtctcgtatagtgtagtagtgggttctccttacgttttacgaacgggttttcgggacggggttaagggcccgaggtctcggacccgttcttacggtcacgaacccgaggtccttccgtccccgttcggtaaccc

SEQ ID NO: 350613 - DNA, 617 bp, Homo sapiens
  misc_feature: GZ8MTXP01DPDO8.10.27.C05.1.454.CMB.2.raw
  modified_base (267)..(267): a, c, t, g, unknown or other
  misc_feature (267)..(267): n is a, c, g, or t
  modified_base (293)..(293): a, c, t, g, unknown or other
  misc_feature (293)..(293): n is a, c, g, or t
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctccgtggacagtcggtcaccatctcctgcacgtcggacccagcactgatggttggactattactaacttgtctctgtanacaacacgccagaacaaacgccccanactnttagtatttanagtaagtacaagtaacgccggtccctcgtagggtttctagtcgtctttcctctcgcctacaagtctgaacaaacgacgtccctacctagactatctcgtcggctccgagctacgacgacgagtctaagtaatattaacgcgacacgtcctaactaagttataggtagtagttcgggttctccgtttacgtttacggtaacggggttttcgggacggggacggtaccgaggtccgtacggttacccgttcgttaacgtccgacggtaacccgtaacgggtccttacccggtcccccgttcggttaacccc

SEQ ID NO: 350614 - DNA, 673 bp, Homo sapiens
  misc_feature: GZ8MTXP01DDS04.10.27.C05.1.454.CMB.2.raw
  modified_base (271)..(271): a, c, t, g, unknown or other
  misc_feature (271)..(271): n is a, c, g, or t
  modified_base (299)..(299): a, c, t, g, unknown or other
  misc_feature (299)..(299): n is a, c, g, or t
  modified_base (314)..(314): a, c, t, g, unknown or other
  misc_feature (314)..(314): n is a, c, g, or t
  modified_base (381)..(381): a, c, t, g, unknown or other
  misc_feature (381)..(381): n is a, c, g, or t
  modified_base (483)..(483): a, c, t, g, unknown or other
  misc_feature (483)..(483): n is a, c, g, or t
tcagcatagtagtgcacgaccggtgctcgatttagacgcgatcgaaggggtttggggggggtcacaagaggcagcgctctcgggacgtctccaccatggcctgggctctgctgctcctcaccctcctcactcaggacacagggtcctgggccctgtctgccctgactcagcctgcctccgtgtcgtgggtctccgtggacagtcgtcaccatctcctgcacgtggacccagcatgatggttggactatttactaaccttgtctccgtgtancaaacacgccaagaaccaaacgccccanactcttagtatttanagaagtcaaggtaacgcccggtacctggtagggtttctagtcgtcttccctctcgcctacaagtccngtaacaaccgtaccggtccctaccgtgaactagtcctcgtgggcctaccgaggctacggaacgacgtaggtactagaacttacttacgcgactacgtctaanaattagtgtaagtgtttcggcttcccgtttacgtttaaccggttaaggggtttccggggacggggttaacgggtaccgttacggtaccgttaccggttaaccccgtttacggttaacggtaaccccgaaacccgggtcccgtaaaccggggtccccgttaccccggtcccccggttgggtttaacccccg

SEQ ID NO: 350615 - DNA, 558 bp, Homo sapiens
  misc_feature: GZ8MTXP01AU65T.10.27.C05.1.454.CMB.2.raw
  modified_base (262)..(262): a, c, t, g, unknown or other
  misc_feature (262)..(262): n is a, c, g, or t
  modified_base (287)..(287): a, c, t, g, unknown or other
  misc_feature (287)..(287): n is a, c, g, or t
  modified_base (302)..(302): a, c, t, g, unknown or other
  misc_feature (302)..(302): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (392)..(392): a, c, t, g, unknown or other
  misc_feature (392)..(392): n is a, c, g, or t
  modified_base (410)..(410): a, c, t, g, unknown or other
  misc_feature (410)..(410): n is a, c, g, or t
tcagcatagtagtgcacgaccggtgctcgatttagacgcgatcgaaggggtttggggggggtcacaagaggcagcgctctcgggacgtctccaccatggcctgggctctgctgctcctcaccctcctcactcaggacacagggtcctgggccctgtctgccctgactcagcctgcctccgtgtcctgggtctcctggacagtcggtcaccatctcctgcactggacccagcatgatgttggcattatacttgtctcctgtancaacacgccagacaaacgcccccanactcttagactttangaagtcagtaacgcgtcctgtagggtttcagtcgcttcnctgctcagtcngcacncgctccngacatcnctggctccgagctagacgagngctagaatattactgacngtctacatagtgtagtagttcgtcgttccttcgtttaccgtaaggggtttcgggacgggttacgggtacccagggtcgtacggaccccgttcgttaaacgccgaaccggtcccgaaagggtcccttaccgggtcccccgttcggtccc

SEQ ID NO: 350616 - DNA, 659 bp, Homo sapiens
  misc_feature: GZ8MTXP01A3WB4.10.27.C05.1.454.CMB.2.raw
  modified_base (266)..(266): a, c, t, g, unknown or other
  misc_feature (266)..(266): n is a, c, g, or t
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (350)..(350): a, c, t, g, unknown or other
  misc_feature (350)..(350): n is a, c, g, or t
tcagcatagtagtgcacgaccggtgctcgatttagacgcgatcgaaagggtttggggggggtcacaagaggcagcgctctcgggacgtctccaccatggcctgggctctgctgctcctcaccctcctcactcaggacacagggtcctgggccctgtctgccctgactcagcctgcctccgtgtcgtggtctcctggacagtccgtcaccatctcctgcactggacccagcactgagtgttggctattactaaccttgtctctgtancaacacgccagacaacgccccanactctgtattangaagtnagtagccgtcctcgtagggtttctacgtcgtcttccctcgtcncctactacgtcgtcggaaccaaccgtccggtccctccgtagacctaacgtccgtacgtcggggcccttaccggaggtccgtacggtaaccggaacggtacgggtaccttaaaggtaacttacgtttaacgcgtacgacgtctaaccgtagttaagtagtcggtattcggtactttcccgtttacgttttacgggtaacggggtttcgggacgggttaacgggaccgttcggtactaccggttaccgttaccgacggtctacccggtaacccggtaggtccccgttcccggccccgtttccggtaacccg

SEQ ID NO: 350617 - DNA, 603 bp, Homo sapiens
  misc_feature: GZ8MTXP01BW1LC.10.27.C05.1.454.CMB.2.raw
  modified_base (262)..(262): a, c, t, g, unknown or other
  misc_feature (262)..(262): n is a, c, g, or t
  modified_base (288)..(288): a, c, t, g, unknown or other
  misc_feature (288)..(288): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattatacttgtctctgtanacaacacgccaagacaaacgccccanactcttagtatttatgaagtacagtaacgccggtccctgtagggtttctagtcgtcttcctctcgcctacaagtctacgcaacgccggtccctcctagactactctcgtaggcctacgaggtctacggacgacgtaggtctagtaatacttacgtcgacgtagtctacaagttagtgtagtagttcggtctcccgtttacgtttacggtaggggtttcggacgggttacgggaccttaggtcctacggttacccgttcgttacgtaaccgaccgtaacccgtaggtcccttacccggtaaccccgttcgtaaccc

SEQ ID NO: 350618 - DNA, 589 bp, Homo sapiens
  misc_feature: GZ8MTXP01AXIUC.10.27.C05.1.454.CMB.2.raw
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgtcaccatctcctgcactggaccagcactgatgttggctattatactgtctctgtancaacacgccanacaaacgccccanactctgatttangaagtcagtaacgccgcctcgtagggtttctagtcgtcttcctctcgcctacaagtctcggcaaaccgccggtcctcccgtagaactaatcctcgtggcctaccgagctgaacgacgtagacgtagaaattactaactgcagtctactaagtatgtaagtacgttcggtcgtacccttgtttaccggtaagggtttcgggacggttacgggaccgaggtccgtaccggacccgttcgttaaaccgtcgaccgaacccgtaacggtcccgttacccggtcccccgttcggtaacccc

SEQ ID NO: 350619 - DNA, 582 bp, Homo sapiens
  misc_feature: GZ8MTXP01EFJ5P.10.27.C05.1.454.CMB.2.raw
  modified_base (262)..(262): a, c, t, g, unknown or other
  misc_feature (262)..(262): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgtcaccatctcctgcactggacccagcactgatgttggctattataacttgtctctggtancaacacgccaagacaaacgcccccacactcttgtatttatgaagtcagtaacgccggtccctcgtaggggtttctagtcgtcttcctctcgccctcaagtctacggcaacgaccggccctcctgacatctcgtggcctcgaggctagacgacgagctagaatattactgacagtcctatatagtgtagtagttggtcgtcccttcgtttacggtaagggttttcggacgggttacgggaccgttaggccgtacggaccgttcgttaacgttccgacgtaacccgtaacggtcccgttaccgtccccccgttcggttcccc

SEQ ID NO: 350620 - DNA, 748 bp, Homo sapiens
  misc_feature: GZ8MTXP01A9X7J.10.27.C05.1.454.CMB.2.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgtcaccatctcctgcactggacccagcactgattgtggctattactaaccttgtctctgtatacaacaccgccaagaccaaacgcccccacacttctagtactttatgaagtcaagtaacgcccggtcccttacggtacggggttttactacggttccgtccttttccctccgttcggaccccttaccgtaaacggttccctacgggtcccgtaaaccgtacccgggtcccccttacccgtacggtaaacctaaacgtttcccgtacggtcggggtaccttcccgacgggtaccgttacggaacccgggtaaccggtaggggtacccttaagtaaaacgtttaacgtttaaacgtcggtaccgtaacgggttaccttaccgtaaagttacggttaagtaaacggtgttacgggttcgtcccgtttacgtttacggttaaacggggttttcgggaccggggttacggtacgacggtcgtacgttacccgttcgttaagtccgacgtaacccgaacggtcccttaccggtaacccccgttcggtaacccc

SEQ ID NO: 350621 - DNA, 595 bp, Homo sapiens
  misc_feature: GZ8MTXP01CJCSH.10.27.C05.1.454.CMB.2.raw
  modified_base (258)..(258): a, c, t, g, unknown or other
  misc_feature (258)..(258): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggcattatacttgtctctgtancaacacgccagacaaacgcccccacactcttgatttatgaagtcagtaactcgaccctcgtaggggtttctgactcgtcctttcttgcctcaagtctggcacaccggcctccctgaccatcctcgtcgggcctcagactgaggacgaggctgattatactgcacgctcaacactaacgaacgcggaccgtaggtcggtttcggggtcggttcggggaaccggggggtaccacggtaccgttccggtaaacccggtccggttacgggttcccgacggtaaccccgaaagggtcccgttcccggtcccccggttaccggttcccgttcccgtttccccg

SEQ ID NO: 350622 - DNA, 629 bp, Homo sapiens
  misc_feature: GZ8MTXP01EIAPK.10.27.C05.1.454.CMB.2.raw
  modified_base (318)..(318): a, c, t, g, unknown or other
  misc_feature (318)..(318): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgtcaccatctcctgcactggacccagcactgtagtggttgggctaatttactaaccttgtctctggtactacaacaaccgccaagaaccaaaccgcccccactactcttagtatttanagaagtacagtaacgccgcctgtagggtttctagtcgtcttcctctcgcctacaagtctacgcaaccgccgtccctccgtagaactactcctcgtcggctccgagcgtacggacgaacggtacggtacgtagtaaactacttacgtcggtactacggtacttactaagttagtagtagtagttcggttcgttccttcgtttaccgttagggtttaacgggcgggacgggtacgaggtccgtacgttaccgttacgttacgtaaccgaccgaaccgtaacggtccgttacccggtccccgttccggttcccg

SEQ ID NO: 350623 - DNA, 758 bp, Homo sapiens
  misc_feature: GZ8MTXP01ANKPX.10.27.C05.1.454.CMB.2.raw
  modified_base (260)..(260): a, c, t, g, unknown or other
  misc_feature (260)..(260): n is a, c, g, or t
  modified_base (298)..(298): a, c, t, g, unknown or other
  misc_feature (298)..(298): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgtcaccatctcctgcacgtgacccagcatgatgtggactattactaacttgtctctgtancaacacgccagacaaacgccccatactcttgtatttanagtaagtcagtaacgccggtcctcgtagggtttctagtcgtcttccctctcgtaccctaccaacgtcgtacgggaaccaaaccgtacccgggtccccttacccgtaggtaacctaaacgtttccctccggttcgggggtcccttaacccggacgggttaccacggggtaaaccggtaccggggaaacggtcccgtaaaggtaaaactttacgtttaaccgtacggtacctaacggtccttaaaccgtaagtttacggtaggttaagttaacggttccgggttccggtttaaccccttttcggttttaaacgggtttaaccgggggttttccgggggacgggttaaaccgggggtaaacccgttcgggtacccgttacggggttaaccccgttcgttaaacggtaaccccgaacggtccccgtaacggtcccgttaccccgtccccgttaacggttccccg

SEQ ID NO: 350624 - DNA, 725 bp, Homo sapiens
  misc_feature: GZ8MTXP01DO53Y.10.27.C05.1.454.CMB.2.raw
  modified_base (264)..(264): a, c, t, g, unknown or other
  misc_feature (264)..(264): n is a, c, g, or t
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattataaccttgtctctggtancaacacgccaagacaaacgcccccanactcttgatttanagaagtcaaggtaacgccggtccctcgtagggggtttctagtcgtctttcctctcgtcctccaagtcctaggccaaacgacccgggtacccctaccctacggaactaacgtcctacgtcggggaccttaccgacgggtcctagggaaccggaacggaggaccttaggtaaaaaacttcgtttaaacgtcgacgtaacgtccttactaagttaacgttggtaagtacgtttcgggttaccgttaccttttacgtttaccggttaaacgggggtttttccggggaacgggggttaaccgggtacccggttaaggggttccccgtacggggttaaccccgtttccggttaaaacggttcccggtaaaccggaaccccggttaaacgggccccgttacccggtcccccccgttcgggttaaccccc

SEQ ID NO: 350625 - DNA, 591 bp, Homo sapiens
  misc_feature: GZ8MTXP01B6T44.10.27.C05.1.454.CMB.2.raw
  modified_base (263)..(263): a, c, t, g, unknown or other
  misc_feature (263)..(263): n is a, c, g, or t
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (459)..(459): a, c, t, g, unknown or other
  misc_feature (459)..(459): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggacccagcactgatgtggctattataacttgtctctggtancaacacgccagaccaaacgcccccanactcttgatttangaagtcagtaacgcggccctgtaggggtttctagtcgtcttcctctgcctaccaagtctgccaacaccggtccctcctgacatctcgtgggacctcgaggctaggacgtacgaggtctagattattactgcaagtctacattatgtagtagttggtntcccttcgtttacgtaaggggttttccgggagggttacgggtacccgagggtcgtacggttaccccggttccttaacggttccgaaccgccccgtaacgggtcccgttcccggtcccccgttcgggttcccc

SEQ ID NO: 350626 - DNA, 574 bp, Homo sapiens
  misc_feature: GZ8MTXP01DNTQA.10.27.C05.1.454.CMB.2.raw
  modified_base (264)..(264): a, c, t, g, unknown or other
  misc_feature (264)..(264): n is a, c, g, or t
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctgtancaacacgccagacaaacgcccccanactcttgatttangaagtcagtaagcggccctcgtagggtttctagtcgcttcctctgcctcaagtctgcacacgcctccctgacatctcgtggctcgagctagacgagagctagaatatactgcagtctcatatgtagagttcggtagtccctttacgtttcggtaaaggggttttccgggacgggttacgggtacccgagggtcctcggttaacccgttccttaaacggtcccgaacggtcccgaacggtcccgttacccgtccccccgttcgggttaacccc

SEQ ID NO: 350627 - DNA, 766 bp, Homo sapiens
  misc_feature: GZ8MTXP01AEA1W.10.27.C05.1.454.CMB.2.raw
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
  modified_base (296)..(296): a, c, t, g, unknown or other
  misc_feature (296)..(296): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgtcaccatctcctgcactggacccagcactgatgttggctattactacttgtctctgtancaacacgccagacaaacgccccanactcttgatttangaatcagtagcgcctgagggtttcagtcgtcttcctctcgccctaccgaagtccgtcgggtaaccaaaccgacccgggcccttccccgtacggtacctaaacgttccgttccgttcggggtacccttcccgacgggtaccgttaccggaaccgggtaaccgggaagggtaccgttaagggtaaaactttaacggtttaacccttgggacccgtaaacggtcctttaacctaaacgtttaagttaggttaaacgtaggtttacgggttccgttccccgttttaccgttttaccgggtttaaacgggggtttttcccggggaaccgggggttaaccgggggaaacccgttacgggtcccgtaacgggttaaccccgtttaccgttaaaaccggttcccgtaaacccggtaaccccggaaaaccggggtccccgttaccccgggtcccccccgtttccggggtttaacccccg

SEQ ID NO: 350628 - DNA, 605 bp, Homo sapiens
  misc_feature: GZ8MTXP01CIW20.10.27.C05.1.454.CMB.2.raw
  modified_base (259)..(259): a, c, t, g, unknown or other
  misc_feature (259)..(259): n is a, c, g, or t
  modified_base (266)..(266): a, c, t, g, unknown or other
  misc_feature (266)..(266): n is a, c, g, or t
  modified_base (283)..(283): a, c, t, g, unknown or other
  misc_feature (283)..(283): n is a, c, g, or t
  modified_base (295)..(295): a, c, t, g, unknown or other
  misc_feature (295)..(295): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgtcaccatctcctgcactggacccagcactgatgtggctattatacttgtctctgtancaacacnccagacaaacgccccanactctgatttangaatcagtaacgccggtccctcgtagggtttctagtcgtcttcctctcgcctacaagtctacggccaacgaccgtccctaccctgactaactctcgtcgggcctcgaggtcctagaccggacgaggtctagaaattacttacgtcgacgacgtcttactaattagtggtaagtacgttgggttcctcccgtttacgtttacggttaacgggtttcgggacggttacgggtaccgaggtccgtacgttacccgttcttacgtaaccacgaacccgacgggtcccttacccggtcccccgttcggttaaccc

SEQ ID NO: 350629 - DNA, 595 bp, Homo sapiens
  misc_feature: GZ8MTXP01A8HUF.10.27.C05.1.454.CMB.2.raw
  modified_base (261)..(261): a, c, t, g, unknown or other
  misc_feature (261)..(261): n is a, c, g, or t
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (359)..(359): a, c, t, g, unknown or other
  misc_feature (359)..(359): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattatacttgtctctgtancaacacgccagacaaacgccccanactnttgatttangaagtcaagtaacgccggccttcgtaggggtttctagtcgtcttcctctcgcctcaagtcnggcaacgaccgcctccctgacactctacgtggctcgagctgacgacgagctagaatatactgcacgctacgatagtgtagtagttggtcgtacctttacgtttacggttaacgggttttccggggacgggttacggggtacccgagggtaccgtaccgggttaacccgttccgttaacggtaaccaccgggaacccgtaacgggtcccgttcccggtcccccgttgggttaacccc

SEQ ID NO: 350630 - DNA, 592 bp, Homo sapiens
  misc_feature: GZ8MTXP01DVAZT.10.27.C05.1.454.CMB.2.raw
  modified_base (263)..(263): a, c, t, g, unknown or other
  misc_feature (263)..(263): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
  modified_base (459)..(459): a, c, t, g, unknown or other
  misc_feature (459)..(459): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctccgtggacagtcggtcaccatctcctgcactggacccagcatgatgttggactattatacttgtctcctgtancaacacgccaagacaaacnccccanactctgatttangaatcagtagccgtcctgtagggtttctagtcgtcttcctctcgcctaccaaggtctacggccaaacgcccggtcccttaccctagaactaacgtctcgtcgggcctaccgagctaggaacgacggagtactagtaaactattacgtgcgtactcctanaattagtgtaagtagttgggttactcctttcgtttacgtagggtttcggcgggttaggacccgttggtacgtacgttacccgttcgttaagtccgacgccgaacgcccgttccgtccccgttcggttaacccc

SEQ ID NO: 350631 - DNA, 808 bp, Homo sapiens
  misc_feature: GZ8MTXP01AD0ZR.10.27.C05.1.454.CMB.2.raw
  modified_base (198)..(198): a, c, t, g, unknown or other
  misc_feature (198)..(198): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacngtcgtcaccatctcctgcacgtcggacccagcacgtgtagttggttggactaatttacttaacctttgtcctccgtagtactacaaacaaccgcccaagaaccaaaccgcccccatacttcttagtactttagagtaacgtcgaagtaacggcccggtcccgttacggtagggggttttcctacggttccgtccttttccccgtccgttcggtaccccctaccgtaaacggtttccgtaacgggtaacccaaaccggtaccccgggtccctttaccccccgtaagtaacccttaaacgtcccttccggtaacggggtccctaaccgggtacgggaccttacgggaaaccggtaccgggaacgggtacttaacggtaaacttaacgtttaaccgcggtacgtacgttaccttaacgtaagttacggttggtaaggttacggtttcgggttaccgttcccgttttaccggtttttacgggttaaacggggttttccggggaacggggttaacgggaccgttacgggtacctaccgggttacccgttacgttaacgaaccccgtacgccccggtaacgtccccggttcccgttcccccggttcgttaaccccg

SEQ ID NO: 350632 - DNA, 632 bp, Homo sapiens
  misc_feature: GZ8MTXP01EOUJ7.10.27.C05.1.454.CMB.2.raw
  modified_base (261)..(261): a, c, t, g, unknown or other
  misc_feature (261)..(261): n is a, c, g, or t
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
  modified_base (419)..(419): a, c, t, g, unknown or other
  misc_feature (419)..(419): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggctattataacttgtctctgtancaacaacgccaagacaaacgcccccanactctgatttangaagtcagtaacgcgcctgagggtttcagtcgcttctctgtccctctaagtctggccaaacaccggccctccctagactaacgtctctgggtcctcgaggctggaaccgacgaggctanaaattagttactgaccagtctacatagtgtaagtagttcggtcgtcctttacgtttacggtaaaggggttttccgggacgggttaacgggtaacccgttagggtaccgttacgggttaccccggttaccgtttaaacggtaacccgaacggttaacccccgaaacgggggtccccttaccccgggtccccccgtttaaccggggtttaacccc

SEQ ID NO: 350633 - DNA, 588 bp, Homo sapiens
  misc_feature: GZ8MTXP01CGMRG.10.27.C05.1.454.CMB.2.raw
  modified_base (261)..(261): a, c, t, g, unknown or other
  misc_feature (261)..(261): n is a, c, g, or t
  modified_base (272)..(272): a, c, t, g, unknown or other
  misc_feature (272)..(272): n is a, c, g, or t
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
  modified_base (394)..(394): a, c, t, g, unknown or other
  misc_feature (394)..(394): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcggtcaccatctcctgcactcggaccagcatgatggtggactattatacttgtctctgtancaacacgccanacaacnccccanctntntattangaancagtacgcgcctgtagggttctgtcgtcttccnctcncctacagttcacggcaaccaccggtccctcccgagactaactcgtcgtcgggctacgngtctgacggacgagctagtaactacgtactgacgtacgtactataattagtagtagtagttcgggtcttaccgtttacgtttacgggttaggggtttccggaggggttacgggtacgcggtaccgtcggttacccgttcgttaacgtcgaaccggccgtacggtcccttacccggtcccccgttcgttaacccg

SEQ ID NO: 350634 - DNA, 723 bp, Homo sapiens
  misc_feature: GZ8MTXP01C5UDN.10.27.C05.1.454.CMB.2.raw
  modified_base (331)..(331): a, c, t, g, unknown or other
  misc_feature (331)..(331): n is a, c, g, or t
  modified_base (539)..(539): a, c, t, g, unknown or other
  misc_feature (539)..(539): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggacccagcactgagttggttggactaatttaactaacctttgtcttcctaggtacacaaaccaacgacccaagaaccaaaccgcccccaatacttacttagtaatttanagtaagtacaaggtacgcccggtaccctcggttaggggtttctacggttcgtcctttcctccgtacgtcccttaccgtaacgttcgtacggaaccgaaacccgcccgggtcccttacccgtacgaacctaaacgtcccttacgtcgggacccttacggacggtcgtacggaacggtacgggacggttactagtaaacttacttaacgngacgtacgtcttaacagtttagtggttaacgtgttaggggtccttccgttttaccggttacggttaaacgggggtttccggggacggggttaacgggtacgttacggtcgtacggttaacccgttcgttaaccgtccgaaaccggtcccgaaggtcccgttacccgtccccgttcgttaacccg

SEQ ID NO: 350635 - DNA, 667 bp, Homo sapiens
  misc_feature: GZ8MTXP01A6Z5Z.10.27.C05.1.454.CMB.2.raw
  modified_base (275)..(275): a, c, t, g, unknown or other
  misc_feature (275)..(275): n is a, c, g, or t
  modified_base (317)..(317): a, c, t, g, unknown or other
  misc_feature (317)..(317): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgtcaccatcctcctgccacgtcggacccagcactgattggttggactaatttactaaccttgtcctcgtggtanacaacaaccgccaagacaaacgccccatactctagtatttanacgaagtcgaagtaacgccggcctggtaggtttcacgtctcttcctctcgcctacaacgtcgtagccacgaccggccctccgtagacactctcgtcggctccgaggctaggacgacggtacgtctagaaattactacgtacgacgtacggtactacgtaagtagtaggtacgtacgtttggggtccttacccgtttacggtttttaccggaacggggttttccggggacgggttaaacgggggtaccttacggggtacccgtaccggttaacccggttcgtttaaaccggccgtaccggaaccccggtaacggtcccggttaccccgtcccccgggttaacggttccccg

SEQ ID NO: 350636 - DNA, 609 bp, Homo sapiens
  misc_feature: GZ8MTXP01EW821.10.27.C05.1.454.CMB.2.raw
  modified_base (256)..(256): a, c, t, g, unknown or other
  misc_feature (256)..(256): n is a, c, g, or t
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (295)..(295): a, c, t, g, unknown or other
  misc_feature (295)..(295): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctggccctgtctgccctgactcagcctgcctccgtgtctggtctctggacagtcgtcaccatctctgcactgaccagcactgatgttggctatttataccttgtctctgtancaacacgccanaacaaacnccccactactcttgatttangatcagtacgccgtcctcgtagggtttctacgtcgtcttccctctcgccctaccaagtccgtagccaaaccgccggtccctccctacgacattcctcgtcgggtctccgaggtcctgaaccggacgtacgtctaagtaacttaacttacgcgtcacgtcttacctattaagtggttaagtagttcgggtcttcccgtttacgtttacggttaacgggttttcggggaacgggttacgggacccgaggtccgtacggaccgttccttaaggccacgaacccggtacggtcccttccgtaacccccgttgttcccc

SEQ ID NO: 350637 - DNA, 559 bp, Homo sapiens
  misc_feature: GZ8MTXP01EFBHK.10.27.C05.1.454.CMB.2.raw
  modified_base (450)..(450): a, c, t, g, unknown or other
  misc_feature (450)..(450): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaaccgcccaagacaaacgcccccacactcttgatttatgaagtcagtaagccggccctcgaggggtttctagtcgcttcctctgcctccaagtctgcaacaccggcctccctgacatctctgggctcgagctgacgacgagctagaatatactgcagctactatatgtagtattagggtntcccttctttacgtaaggggttttcggacgggacgggaccttagggcgtcgttaaccgttccgttaagccgacgcccgaacggtccgttccgtccccgttcggtaaccc

SEQ ID NO: 350638 - DNA, 551 bp, Homo sapiens
  misc_feature: GZ8MTXP01AUD92.10.27.C05.1.454.CMB.2.raw
  modified_base (260)..(260): a, c, t, g, unknown or other
  misc_feature (260)..(260): n is a, c, g, or t
  modified_base (284)..(284): a, c, t, g, unknown or other
  misc_feature (284)..(284): n is a, c, g, or t
  modified_base (448)..(448): a, c, t, g, unknown or other
  misc_feature (448)..(448): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattatacttgtctctgtancaacacgccagacaacgcccccanactctgtatttatgaagtcagtaacgccggtccctcgtagggtttctagtcgtcttcctctcgccctccaagtcctgccaacaccggccctccctgactatcctcgtcgggcctcgaggctaggacgacgaggctagtaatactactgcagctacagtatgtanagtgtcgtcttcgttcgtaagggtttcggacggacgggtacaggtctacgttaccgttcttacgtccacgtaaccggacgtccgttccccgtccgttctcccg

SEQ ID NO: 350639 - DNA, 648 bp, Homo sapiens
  misc_feature: GZ8MTXP01BQCE9.10.27.C05.1.454.CMB.2.raw
  modified_base (263)..(263): a, c, t, g, unknown or other
  misc_feature (263)..(263): n is a, c, g, or t
  modified_base (345)..(345): a, c, t, g, unknown or other
  misc_feature (345)..(345): n is a, c, g, or t
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattataaccttgtctctgtancaaacaacgccagacaaacgccccacactcttgatttatcgaatcaagtaacgccgcccgtgagggtttctagcgtcttccnctgcctcaagttcnggcaacnccgtctccanacatcntggctccgagtcgagaccgagaggtcctagaacttagttacctggacgtaagtccttaacgtagttacgtagtagttacgttcgggttaccttaccgtttaccggttttaaccgggttaacgggggtttccgggaccgggggttaaacgggtaccccgttacgggtaccgttaaccgttaaccccgggttaccgttaaaccggtcccgaacccggtaaccgaacccgggtccccgttacccggtcccccgttaaccggttaacccg

SEQ ID NO: 350640 - DNA, 678 bp, Homo sapiens
  misc_feature: GZ8MTXP01DIH1W.10.27.C05.1.454.CMB.2.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (271)..(271): a, c, t, g, unknown or other
  misc_feature (271)..(271): n is a, c, g, or t
  modified_base (285)..(285): a, c, t, g, unknown or other
  misc_feature (285)..(285): n is a, c, g, or t
  modified_base (316)..(316): a, c, t, g, unknown or other
  misc_feature (316)..(316): n is a, c, g, or t
  modified_base (370)..(370): a, c, t, g, unknown or other
  misc_feature (370)..(370): n is a, c, g, or t
  modified_base (403)..(403): a, c, t, g, unknown or other
  misc_feature (403)..(403): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtcgtggtctccgtggacngtcgtcaccntctcctgcactcggacccagcactgagttggtggactatttaactaccttgtctcgtgtanacaacaccgccaanaaccaaaccgccccatactcttgtaatttanagaatacgagtacgcccgtacctcggttagggtttctacgtctcttcctcgtcncctacagtcgtcgccaacgccgtccctccgtanactatccgtcgtcggcctacgacggtcgtacggaacggtaccggaggtactacgtaacttacgttacgtcgacggtaacgtccttaatagttagtagtagttggttcgttcgttccgtttacggtttccggggttcggggtttccgggacggggttacgggtacccgttacgggttccgtaaccgggttacccgttaccgttaaaccggtcccggtaaaccggtaacccggtaccgggtcccgttaccccgggtccccgttcgggtttaaccccc

SEQ ID NO: 350641 - DNA, 630 bp, Homo sapiens
  misc_feature: GZ8MTXP01A3A9Q.10.27.C05.1.454.CMB.2.raw
  modified_base (312)..(312): a, c, t, g, unknown or other
  misc_feature (312)..(312): n is a, c, g, or t
  modified_base (373)..(373): a, c, t, g, unknown or other
  misc_feature (373)..(373): n is a, c, g, or t
  modified_base (388)..(388): a, c, t, g, unknown or other
  misc_feature (388)..(388): n is a, c, g, or t
  modified_base (401)..(401): a, c, t, g, unknown or other
  misc_feature (401)..(401): n is a, c, g, or t
  modified_base (408)..(408): a, c, t, g, unknown or other
  misc_feature (408)..(408): n is a, c, g, or t
  modified_base (427)..(427): a, c, t, g, unknown or other
  misc_feature (427)..(427): n is a, c, g, or t
  modified_base (445)..(445): a, c, t, g, unknown or other
  misc_feature (445)..(445): n is a, c, g, or t
tcagcatagtagtgcacgaccggtgctcgatttagacgcgatcgaagggtttggggggggtcacaagaggcagcgctctcgggactctccaccatggcctgggctctgctgctcctcaccctcctcactcaggacacagggtcctgggccctgtctgccctgactcagcctgcctccgtgtctgggtctccgtggacagtcggtcaccatcctcctgcactcggacccagcatgatggttggctattataaccttgtctctggtacacaacaaccgccagaaccaaacgcccccatactcttagtatttacngaagtcaggtaacgccggtcctgtacgggtttctagtcgtcttcctctcgcctcaagttcngcacgaccgcctccngactactcgtcgnggtaccncgaggctggaacgtacggngtactaagaattacttancggacagcttacgagttagtacgtaagtcgttacggttctacctttacgtttacggttaacggggtttcgggaacggggttaaccggtaccggcggtaccgtacggttaacccgttacgtttaacggccgaaccggtaacccgtaagggtccccttcccggtccccccgttaacggtttcccccg

SEQ ID NO: 350642 - DNA, 805 bp, Homo sapiens
  misc_feature: GZ8MTXP01BYMCR.10.27.C05.1.454.CMB.2.raw
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacgagggtcctgggccctgtctcgccctgactcagcctcgcctccgtgtcgtcgggtctccgtggactagtccggtcacctactcctcctgctacgtcggacccagactacgtgtagttggttggactaatttactaaccgttgtccttccgtaggtactaccaaacgaccgacccaacgtaaccaaaccgaccccccaactacttcttacgttaattttaacgtagtaacgttacgacggtaacgcccggtccccgtacgggttacggggtttccgttacggttcctccgtttcccctccgttccgacccgtaccgtaacgtacgtaccgcccgaaaccgtacccgggtcccttaccctacgtaacctaactccgtccgttcgggtacccgtaccgacggtccgtacggaaccgtacgggacgtagtacgtaaatacttaacgtcgactacggtcctataagtgttacgtagttacgtcggttccttccgtttacgtttaaccgggtttgggtttaaccgggggaacgggttaccgggtaaacccggttcggtaacccggtaaccgggttaaccccgttaccgttaaacggttaaccccggaccgtaaccccggggttaacccgtcccggttacccccggtcccggtttccccgtttaaccccccgg

SEQ ID NO: 350643 - DNA, 818 bp, Homo sapiens
  misc_feature: GZ8MTXP01BTEJQ.10.27.C05.1.454.CMB.2.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggacccagctactgatggttcgggactaatttactaaccttcgtctcgtaggtactacaaacaacgacccaacgaaccaaaccgcccccactactcgttagtactttatacgaagtacgaagtacgccggtccctacggtacgggtttctagtccgttcttccccttcgtcgtcctaccgtacgtacgtcggaaccaacctacccgggtcccttacccgtacgtactaacttcccgttcggtcgggtacctccggacgggtaccgttagggaaacccggtaacggtacggggtaacttaacggtaaacgtttaaacttaccgtacggtacctaacggttccttaaccgtagtttaaacggtcggtaacggttaaggttcccggggttacgtttcccggttttaaccggtttttaaccggggtttaaaccggggggttttccggggtaaccgggggttaacggggtaccccggttacgggttacccgttaaccggggttaacccccgtttcggttaaaccgggtcccgtaacccgggtaaccccgggtaaccgggtaccccggttcccccggttcccccggttaaccgggttcccccg

SEQ ID NO: 350644 - DNA, 570 bp, Homo sapiens
  misc_feature: GZ8MTXP01AMBBY.10.27.C05.1.454.CMB.2.raw
  modified_base (251)..(251): a, c, t, g, unknown or other
  misc_feature (251)..(251): n is a, c, g, or t
  modified_base (260)..(260): a, c, t, g, unknown or other
  misc_feature (260)..(260): n is a, c, g, or t
  modified_base (284)..(284): a, c, t, g, unknown or other
  misc_feature (284)..(284): n is a, c, g, or t
  modified_base (397)..(397): a, c, t, g, unknown or other
  misc_feature (397)..(397): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgtcaccatctcctgcactggacccagcactgatgttggctattatacttntctctgtancaacacgccagacaaacgccccanactctgtatttatagaagtcagtaacgccgtccctgtagggtttctagtcgtcttcctctcgccctaccagtctacgcaacgccgcctccctgactactctcgtcggcctcgngctagacgacgagctagaattactactgacgtatcgtactattagtgtagtagttcggttcgtcctttacgtttacggttaagggtttcggacgggttacggtaccgaggtccgtacgacccgttcgttacgtccgacgcccgacggtcccttaccggtccccgttcggtccc

SEQ ID NO: 350645 - DNA, 665 bp, Homo sapiens
  misc_feature: GZ8MTXP01CCFKQ.10.27.C05.1.454.CMB.2.raw
  modified_base (292)..(292): a, c, t, g, unknown or other
  misc_feature (292)..(292): n is a, c, g, or t
  modified_base (313)..(313): a, c, t, g, unknown or other
  misc_feature (313)..(313): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcacccctcctcactcaggacacagggtcctgggccctgtctgccctgactcagcctgcctccgtgtcgtggtctccgtggacagtcgtcaccatctcctgcactcggacccagcagtgtatggtggactaattactaccttgtctcgtagtacacaacacgaccaagacaaaccnccccatactcttagtatttanagaacgtacgagtacgccggtccgttacggtaggtttctacgtcttccttcctcgtcgtcctacctaacgtcgtacgaaccaaccgtacccggtccctcctagacctactccgtcgtcggcctcggacggtcacgggaaccgtacggtagtacgtaagtaattacttaacgtcgacggacttacctagtaagttagttaggtaagttcggtttacggtaccgtttccgtttacgttttacgggttaaccggggtttcggaacggggttacggtaccgagttcccgtacggttacccgttgttacgtaaccgacgtaaccgcgtacccgttcccgtcccgttcgttaaccccg

SEQ ID NO: 350646 - DNA, 658 bp, Homo sapiens
  misc_feature: GZ8MTXP01BN5DB.10.27.C05.1.454.CMB.2.raw
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
  modified_base (419)..(419): a, c, t, g, unknown or other
  misc_feature (419)..(419): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgccctcgtgtctgggtctcctggacagtcgtcaccatctcctgcactgacccagcactgatgttggctattatacttgctctgtancacaacgccaanaccaaacnccccatactcttgactttanagtaagtcaagtaacgccggtccctacgtagggggtttccaggttccgtctttcccgtcctcggacccttcccgtaaagtcccgttagggaacctaaacccgaccgggtccctcccgttanactaaactccgttcgttcgggacccttcgacgggtcaggaaccggtacggaacggtcctaggtaaacttactttaacgtagaccgtactactactaagtacgtagtacggtagttcggttccttccgtttacgtttacggttacgggtttcggacgggttacgacgttcggtcgtaccggttaccgttacgttaacgtccgaccggtaaccgcgtcccgttacccgtccccgttcgtcc

SEQ ID NO: 350647 - DNA, 646 bp, Homo sapiens
  misc_feature: GZ8MTXP01ENASC.10.27.C05.1.454.CMB.2.raw
  modified_base (263)..(263): a, c, t, g, unknown or other
  misc_feature (263)..(263): n is a, c, g, or t
  modified_base (270)..(270): a, c, t, g, unknown or other
  misc_feature (270)..(270): n is a, c, g, or t
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
  modified_base (625)..(625): a, c, t, g, unknown or other
  misc_feature (625)..(625): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctccgtggacagtcgtcaccatctcctgcactcggacccagcactgatggttggctattactacttgtctctgtancaacacnccaagacaacgccccanctctagatttangaagtanagtaacgcccgtaccgtcgtagggtttctacgtcgtcttcccgtctcgtccctaccgaacgtcctcgggccaaacccgtacccgggtccccttaccccgtagtaaaccctaacgttccgttaccgttcggggaccttcccgacggtcgtacggaaaccggtacggtaggacgttagaaattactaacgttcgacgtagtctactattagtgtaagtgttcggtctccgtttacgtttacggtaacgggtttccgggaaggttcgggaacgttaggccgttacggaccgttacgttacgtcaacccgtccgaacggtccncccgtccccgttcggtaaccc

SEQ ID NO: 350648 - DNA, 710 bp, Homo sapiens
  misc_feature: GZ8MTXP01AJWZG.10.27.C05.1.454.CMB.2.raw
  modified_base (255)..(255): a, c, t, g, unknown or other
  misc_feature (255)..(255): n is a, c, g, or t
  modified_base (264)..(264): a, c, t, g, unknown or other
  misc_feature (264)..(264): n is a, c, g, or t
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacaggtcgtcaccatctcctgcactcggacccagcactgatgttggctattactaacttntctctgtancaacacgccagacaacgccccanactcttgatttangaagtcagtaacgcggtcccgtacgtagggggttttactacgtcgtcgtttacctccgttcgtaccccttaccgtaaaggttcccgttacgggaacccgtaaacccgtaaacccgggtaccccttccccgtaacgtacctaaactttcccgtacgttcggggtacccttcccggaacgggtctcgggaaccgacggtacggcttaaggtaacttaacgttacgttcgacgggacgtaccttacgaaactttaacctaaccgaacccaggtaaccaacgtcctaacctttccttagggtaacgttcgggggaccggtaaacggggaacctaaaggcccgttcgttaccccggttaccgtaacggtacgaacccggacccgaacgggttccctaacccgggcccccttcggg

SEQ ID NO: 350649 - DNA, 535 bp, Homo sapiens
  misc_feature: GZ8MTXP02G3FLS.10.27.C05.1.454.CMB.2.raw
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
tcagcatagtagtgcacgaccggtgctcgatttagacgcgatcgaagggtttgggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaaacacgcccagacaaagccccanactctgatttangaagtcagtaagcggccctnaggggtttcagtcgcttcctctgcctccaagtctgggccaacacggccctccctgacaatctctggctccaggctgacgacgaggctagaatattactgcagctacatatagtagatgtcgccttctttcgaaacgggttttcggccgggtagggaccgaggcgtacgaccgtaccgtaaagtcgacgacccgaacggcctcggccccctcggtacc

SEQ ID NO: 350650 - DNA, 511 bp, Homo sapiens
  misc_feature: GZ8MTXP02JC60G.10.27.C05.1.454.CMB.2.raw
  modified_base (286)..(286): a, c, t, g, unknown or other
  misc_feature (286)..(286): n is a, c, g, or t
  modified_base (319)..(319): a, c, t, g, unknown or other
  misc_feature (319)..(319): n is a, c, g, or t
tcagcatagtagtgcacgaccggtgctcgatttagacgcgatcgaagggtttgggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacacgcccagacaaagcccccanactcttgatttatgaagtcagtaagcggccctnaggggtttcagtcgcttcctctgcctccaagtctggcaacacggcctccctgacaatctctgggctccaggctgacgacgaggctgaatattactgcagctcatatgtagatggtcgccttctttcgaaggttttcggcggtagggaccgaggctgacccgtctaagtcagcccaggctcgccccctggtcc

SEQ ID NO: 350651 - DNA, 532 bp, Homo sapiens
  misc_feature: GZ8MTXP02HIPTU.10.27.C05.1.454.CMB.2.raw
  modified_base (297)..(297): a, c, t, g, unknown or other
  misc_feature (297)..(297): n is a, c, g, or t
  modified_base (357)..(357): a, c, t, g, unknown or other
  misc_feature (357)..(357): n is a, c, g, or t
tcagcatagtagtgcacgaccggtgctcgatttagacgcgatcgaagggtttgggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctctgtatcaacacgcccagacaaagcccccacactcttgatttangaagtcagtaagcgccctgagggtttctagtcgcttcctctgcctcaagtctggcaaacncgcctccctgacatctctggctcaggctgacgacgagctgaatattatgcagctcatatgtagatggtgtccttacgtttacgaacgggttttcggacgggttaggacccgaagggcctacgacccgttccgtaaagtccgacgaccccgaaggtcctcgcccccgttcggtccc

SEQ ID NO: 350652 - DNA, 546 bp, Homo sapiens
  misc_feature: GZ8MTXP02GFQMV.10.27.C05.1.454.CMB.2.raw
  modified_base (301)..(301): a, c, t, g, unknown or other
  misc_feature (301)..(301): n is a, c, g, or t
  modified_base (461)..(461): a, c, t, g, unknown or other
  misc_feature (461)..(461): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacacgcccagacaaagcccccacactcttgatttangaagtcagtaacgcggccctcgagggtttctagtcgcttcctctgctccaagtcctggcaacacggcctcctgacaatctctggctcaggctgacgacgagctgaatattactgcagctcatatgtagatggtcgccttcgtttcaacgggtttttcggnggtacggggacctaggccgtacgtacccggttcctaaacggtccgaacgccccgaaacggccccgccccgtccggtacctacccg

SEQ ID NO: 350653 - DNA, 548 bp, Homo sapiens
  misc_feature: GZ8MTXP02JK858.10.27.C05.1.454.CMB.2.raw
  modified_base (298)..(298): a, c, t, g, unknown or other
  misc_feature (298)..(298): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctgtatcaacacgccagacaaacgccccacactcttgatttangaagtcagtaagccggccctgtaggggtttctagtcgtcttccctctcgcctccaagtctggcaacacggcctcctgacatctcgtggctccgagctgacgacgagctagaatattactgacagtctacatatgtagagtggtctccttcgtttacgtaacgggttttcggcgggtacggaccgaggtcgtacgacccgtaccgtaacgtccgacgacccgaacggtcctccgtcccccgtacggtcccg

SEQ ID NO: 350654 - DNA, 595 bp, Homo sapiens
  misc_feature: GZ8MTXP02H0AVZ.10.27.C05.1.454.CMB.2.raw
  modified_base (295)..(295): a, c, t, g, unknown or other
  misc_feature (295)..(295): n is a, c, g, or t
  modified_base (308)..(308): a, c, t, g, unknown or other
  misc_feature (308)..(308): n is a, c, g, or t
  modified_base (437)..(437): a, c, t, g, unknown or other
  misc_feature (437)..(437): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtctgtcacatctctgcacgtcggacccagcactgagttggttggactattactaaccttgtctcctggtatacaacaccgccagaacaaccgccccanactctgtatttangaagtcaagtacgcgtcctgtagggtttcagtcgtccttctctgccctacagtcgtggactaacgaccgccctcctgaactactcgtcgtcggctcgagcgtagaccgacgagctagtaatactttacngacagtctactatagtgtaagtcgtgttccgtccttcgtttacggttacggttttacgggacggggtaacggtacccgtacggtccgttacggtaacccgttaccgttaaacgcgaaccggacccgtaacggtcccgttcccggtcccccgtttccgg

SEQ ID NO: 350655 - DNA, 552 bp, Homo sapiens
  misc_feature: GZ8MTXP02GELS5.10.27.C05.1.454.CMB.2.raw
  modified_base (367)..(367): a, c, t, g, unknown or other
  misc_feature (367)..(367): n is a, c, g, or t
  modified_base (405)..(405): a, c, t, g, unknown or other
  misc_feature (405)..(405): n is a, c, g, or t
  modified_base (415)..(415): a, c, t, g, unknown or other
  misc_feature (415)..(415): n is a, c, g, or t
  modified_base (437)..(437): a, c, t, g, unknown or other
  misc_feature (437)..(437): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacacgcccagacaaacgccccacactcttgatttatgaagtcagtaagccggtccctcgtaggggtttctagtcgtcttcctctgcctcaagtctggcaacncggcctcctgacatctctggctccgaggctgacgacgnggctagaatnttactgcagctcatatagtagngttggtctccttctttacgtaaggttttcggacggtacgtccgaacgtacggctacggacccgttaccgtaaagtcccgaacgtacccgaacggtcctcccggtcccccttccgg

SEQ ID NO: 350656 - DNA, 552 bp, Homo sapiens
  misc_feature: GZ8MTXP02JX3MM.10.27.C05.1.454.CMB.2.raw
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctctgtatcaacacgccagacaaacgccccacactcttgatttatgaagtcagtaacgcggccctgaggggtttctagtcgcttcctctgcctccaagtctggcaacacggcctcctgacaatctcgtcgggctccgaggctgacgacgagctagaatattactgcagctacatatgtagatggtcgtccttctttacgtaagggttttccggacgggtacgggtaccgacggcgtacgaccgtaccgtaaacgtccgacggtacccgaacggtcctccggtcccccgttcggtaccccg

SEQ ID NO: 350657 - DNA, 537 bp, Homo sapiens
  misc_feature: GZ8MTXP02GYA5U.10.27.C05.1.454.CMB.2.raw
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggcattataaccttgtctcctggtatcaaacaacgcccagacaaacgccccanactcttgatttangaagtcagtaagcgccctgaggggtttcagtcgcttcctctgcctccaagtctggcaacacgcctccctgacaatctctggctccaggctgacgacgaggctgaatattaactgacagctcatatgtagagttggtcgtccttctttacgaaagggttttcgggacggtacgggaccaggtcgtcgaacccgtcctaaagtcgaacgcccaaaggcctcgcccccgtcggtaccc

SEQ ID NO: 350658 - DNA, 534 bp, Homo sapiens
  misc_feature: GZ8MTXP02GCP1G.10.27.C05.1.454.CMB.2.raw
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctctggtatcaacacgccagacaaagccccanactctgatttangaagtcagtaagcgcctcgtagggtttcagtcgcttcctctgctcaagtctgcaacacggcctcctgacaatctctggctcagctgacgacgaggctgaatattactgcagtctcatatgtagagtggtcgcttcgtttcgtaaagggttttcggacgggtaagggacccgtaaggcttacggacccgtcttaaaacggtcaacgcccgaaacggcctaccggcccccgtcggtaccc

SEQ ID NO: 350659 - DNA, 561 bp, Homo sapiens
  misc_feature: GZ8MTXP02F4O11.10.27.C05.1.454.CMB.2.raw
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctctgtatcaacacgccagacaaacncccccanactctgatttangaagtcagtaagcggcctgagggtttcagtcgcttctctgcctcatctggcacacgcctcctgacatctctggctcgagctgacgacgaggctgaatattactgcagctacatatgtagagtggtgtccttcgtttacgtaagggtttttcggacgggtacgggacccgaaggggtcctacggtaacccgttaccgtaaacggttcccgaacggtaccccgaaacggggtcccttacccggtccccccgttacgggttaccccg

SEQ ID NO: 350660 - DNA, 538 bp, Homo sapiens
  misc_feature: GZ8MTXP02FRX5R.10.27.C05.1.454.CMB.2.raw
  modified_base (289)..(289): a, c, t, g, unknown or other
  misc_feature (289)..(289): n is a, c, g, or t
  modified_base (443)..(443): a, c, t, g, unknown or other
  misc_feature (443)..(443): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggcattataaccttgtctcctggtatcaacaacgcccagacaaacgcccccanactcttgatttatgaagtcagtaagcggccctcgtaggggtttctagtcgcttcctctgcctcaagtctggcaacacggcctccctgacatctctggctcaggctgacgacgaggctgaatattactgcagctcaatagtagtagtatgggtcnccttcgtttcgaacgggttttcggacgggtagggacccgagggtctacgaccgtctaagtccgacgcccgaacggtcctcgtccccctcggtccc

SEQ ID NO: 350661 - DNA, 507 bp, Homo sapiens
  misc_feature: GZ8MTXP02H594N.10.27.C05.1.454.CMB.2.raw
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
tcagcatagtagtgcacgaccggtgctcgatttagacgcgatcgaagggtttgggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacaacgcccagacaaagcccccacactcttgatttangaagtcagtaagcggccctnaggggtttcagtcgcttcctctgcctccaagtctggcaacacggcctcctgacatctctggctcagctgacgacgagctgacttattactgcagctcacatacaagcgcaggtcggtgggtgttcgggcgggggacacgacgtgaccgtccgaggtcagcccgaaggctcgcccctcggtcactccg

SEQ ID NO: 350662 - DNA, 539 bp, Homo sapiens
  misc_feature: GZ8MTXP02HJ1RM.10.27.C05.1.454.CMB.2.raw
  modified_base (300)..(300): a, c, t, g, unknown or other
  misc_feature (300)..(300): n is a, c, g, or t
  modified_base (415)..(415): a, c, t, g, unknown or other
  misc_feature (415)..(415): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacacgcccagacaaacgccccacactctgatttangaagtcagtaagcggccctgaggggtttctagtcgcttcctctgcctcaagtctggcaacacggcctccctgacaatctcgtggctccgagctgacgacgagctagaatattacngcagtctcatatgtagagtggtgccttcgtttacgtaagggttttcgggacgggtagggaccgagggctacgtaccgtaccgtaagtccacggacccgaacggcctcgcccccgttcggtaccc

SEQ ID NO: 350663 - DNA, 572 bp, Homo sapiens
  misc_feature: GZ8MTXP02G1IWH.10.27.C05.1.454.CMB.2.raw
  modified_base (300)..(300): a, c, t, g, unknown or other
  misc_feature (300)..(300): n is a, c, g, or t
  modified_base (365)..(365): a, c, t, g, unknown or other
  misc_feature (365)..(365): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattgtaaccttgtctcctgtatcaacacgcccagacaaagcccccacactcttgatttangaagtcagtaagccggccctcgaggggtttctagtcgtcttcctctgcctccaagtctggcaacncggcctccctgacaatctctggctcaggctgacgacgagctagaatattactgcagctcatatgtagagtggtcgtccttctttacgtaacgggtttttcgggacgggtaaggggacccgtagggtccgtacggtaacccgttaccgtaaacggttccgaacggaccccgaaacggtcccgtccggtcccccccgtacggttccccg

SEQ ID NO: 350664 - DNA, 537 bp, Homo sapiens
  misc_feature: GZ8MTXP02GEFAX.10.27.C05.1.454.CMB.2.raw
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacaacgcccagacaaagcccccanactcttgatttangaagtcagtaagcggccctcaggggtttctagtcgcttcctctgcctcaagtctggcaacacggcctcctgacatctctggctcagctgacgacgagctgaatattactgcagctcatatgtagatggtcgccttctttcgtaaaggtttttcggacggggtagggtaccgaagggcttcggaacccgtccgttaacgtcgacgcccaaacggccttcgcccccgttcggtacccg

SEQ ID NO: 350665 - DNA, 597 bp, Homo sapiens
  misc_feature: GZ8MTXP02IY4WB.10.27.C05.1.454.CMB.2.raw
  modified_base (300)..(300): a, c, t, g, unknown or other
  misc_feature (300)..(300): n is a, c, g, or t
  modified_base (374)..(374): a, c, t, g, unknown or other
  misc_feature (374)..(374): n is a, c, g, or t
  modified_base (427)..(427): a, c, t, g, unknown or other
  misc_feature (427)..(427): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaacatctcctgcactggacccagcactgatgttggcattataaccttgtctctgtatcaacacgcccagacaaacgcccccacactcttgatttangaagtcaagtaacgccggccctcgtaggggtttctagtcgtcttcctctcgccctacctaagtcctggccaacnccggtccctccctagacatctcgtggcctcgaggctgacgacgagctagaatnttactgcagtctactatatgtagtagttggtcgtcctttcgtttacgtaacgggttttcgggacgggtaacggggtaccgtagggtccgtaccggtaacccgttaccgtaaacgtccgaccggtacccggtaaacggtcccgtaccccggtacccccgttccggtacccg

SEQ ID NO: 350666 - DNA, 591 bp, Homo sapiens
  misc_feature: GZ8MTXP02GW8RB.10.27.C05.1.454.CMB.2.raw
  modified_base (438)..(438): a, c, t, g, unknown or other
  misc_feature (438)..(438): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaaacaacgcccagacaaacgcccccacactcttgatttatgaagtcagtaagccggccctcgaggggtttctagtcgtcttcctctgcctcaagtctggcaaacacggccctccctgacaactctctgggctccgaggctgacgacgaggctagaatattactgcagctcatangtagatggtcgccttcgtttacgtaaagggttttcggacggggtaacgggacccgtagggtcctacgggtaccccgttaccgtaaacggttccgaaaccggtacccccgaaaacggggtcctttacccggacccccccgtttacgggttcccc

SEQ ID NO: 350667 - DNA, 575 bp, Homo sapiens
  misc_feature: GZ8MTXP02FZH85.10.27.C05.1.454.CMB.2.raw
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
  modified_base (362)..(362): a, c, t, g, unknown or other
  misc_feature (362)..(362): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacaacgcccagacaaacgcccccanactctgatttangaagtcagtaagcggccctgaggggtttcagtcgcttcctctgcctccaagtctggcaacncggcctccctgacatctctggctccaggctgacgacgagctgaatattactgcagctacatatgtagtatggttgccttacgtttcgtaagggttttccgggacgggtacggggaccgtagggtcgttacggacccgttaccgtaaacggttccgaacggtacccccgaaacggggtcccccgtaccccccggttccgggtaccctaaccccg

SEQ ID NO: 350668 - DNA, 538 bp, Homo sapiens
  misc_feature: GZ8MTXP02G0DLF.10.27.C05.1.454.CMB.2.raw
  modified_base (286)..(286): a, c, t, g, unknown or other
  misc_feature (286)..(286): n is a, c, g, or t
  modified_base (299)..(299): a, c, t, g, unknown or other
  misc_feature (299)..(299): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctctggtatcaacacgcccagacaaagcccccanactcttgatttangaagtcagtaagcggccctgaggggtttcagtcgtcttcctctgcctcagtctgcaacgcgcctccctgacatctctggcctcgaggctgacgacgagctagatattactgcagctcattatgtagattggtcgtcccttacgtttcgtaagggttttcggcgggtagggaccgaggtccgtcgacccgtaccgtaagtccgtacgacccgaacggccgtccgcccccgtcggtacccg

SEQ ID NO: 350669 - DNA, 518 bp, Homo sapiens
  misc_feature: GZ8MTXP02FYHDV.10.27.C05.1.454.CMB.2.raw
  modified_base (290)..(290): a, c, t, g, unknown or other
  misc_feature (290)..(290): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaacgcccccanactcttgatttatgaagtcagtaagcggccctcgaggggtttctagtcgcttcctctgcctcaagtctggcacacggcctcctgacatctctggcctcagctgacgacgtaggctgaatattactgcagctcatatgtagatggtcgccttcgtttacgaagggttttcggcgggaggaccgaggcctagaccgtctaagtcacgccaacggctcgcccctcggtacc

SEQ ID NO: 350670 - DNA, 576 bp, Homo sapiens
  misc_feature: GZ8MTXP02GVBSO.10.27.C05.1.454.CMB.2.raw
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataacccttgtctcctggtatcaacaacgcccagacaaacgccccanactcttgatttangaagtcagtaaagccggccctcgtaggggtttctagtcgcttccgtctgcctccaagtctggcctaacacggcctccctgacaatctctggctcagctgacgacgagctagaatattaactgcagctctatatagtagagtggtctccttacgtttacgtaaacgggtttttcgggacgggtaacgggacccgacgggtaccgtacggtacccgtaccgttaacgtaaccgaacgaccccgaaacggccttcccggcccccgtcggttaccccg

SEQ ID NO: 350671 - DNA, 557 bp, Homo sapiens
  misc_feature: GZ8MTXP02H9N2I.10.27.C05.1.454.CMB.2.raw
  modified_base (282)..(282): a, c, t, g, unknown or other
  misc_feature (282)..(282): n is a, c, g, or t
  modified_base (294)..(294): a, c, t, g, unknown or other
  misc_feature (294)..(294): n is a, c, g, or t
  modified_base (371)..(371): a, c, t, g, unknown or other
  misc_feature (371)..(371): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattatacttgctctgtatcaacacgcccagacaaagccccacnctcttgatttangaagtcaagtaacgcggcctgacggggtttctagtcgcttctctgcctcagtctggcaacacgcctcctgacaatcncgtgctcagctgacgacgagctagatatatgtcagtctcatatagtaagtatggtgtccttacgtttacgtaagggttttcggacgggttacgggaccgtacggtaccgtacgtacccgttaccgtaaacgttaaccgacgtaccccgaaacggtccgtacccgtacccccgttaccggtaccccg

SEQ ID NO: 350672 - DNA, 535 bp, Homo sapiens
  misc_feature: GZ8MTXP02GGSB9.10.27.C05.1.454.CMB.2.raw
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataacttgtctcctgtatcaacaacgcccagacaaacgcccccanactcttgatttangaagtcagtaatcgaccctcgtaggggtttctgatcgccttcttgcctccaagtctgcaacacgcctcctgaccatctctggcctcagactgagacgaggctgattattactgacagctacacataacgaagcggcaggcggttgggtggttcggggcgggggtaccacgacgtacgaccgtccgtacggtcgacgcccgaacggccgtacgcccccgtcggtcctacttcccg

SEQ ID NO: 350673 - DNA, 546 bp, Homo sapiens
  misc_feature: GZ8MTXP02IBK62.10.27.C05.1.454.CMB.2.raw
  modified_base (285)..(285): a, c, t, g, unknown or other
  misc_feature (285)..(285): n is a, c, g, or t
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctctgtatcaacaacgccagacaaagcccccanactcttgatttatgaagtcaagtaagcggccctgaggggtttctagtcgtcttcctctgcctccaagtctggcaacacgcctccctnacatcnctggctcagctgacgacgaggctagatattacngcagtntatatagtagtagtagtgtcgtccttacgttacgttaacggtttcggacgggtacgggacgtacggtacgtacgtaccgttacgtaacgtccgacgacccgtacgtaccgtcccgtccccgttacgtcc

SEQ ID NO: 350674 - DNA, 565 bp, Homo sapiens
  misc_feature: GZ8MTXP02J25JB.10.27.C05.1.454.CMB.2.raw
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatggttggctattataaccttgtctcctggtatcaacacgcccagacaaacgccccanactcttgatttangaagtcagtaagcggcctcgtagggtttctagtcgtcttcctctgcctaccaagtctggcaacgaccggtcctcctgactaatcctcgtgggcctccgacggctgacgacgaggctagtatatactgcagctcatatgtagtagtcggtcgtccttcgtttacgtaacggttttcgggacgggtacgggaccgtacggtcgttacgaccgttacctaacgtccgacggacccgaacggtccttccgcccccgtacggtcccg

SEQ ID NO: 350675 - DNA, 540 bp, Homo sapiens
  misc_feature: GZ8MTXP02G8UD6.10.27.C05.1.454.CMB.2.raw
  modified_base (292)..(292): a, c, t, g, unknown or other
  misc_feature (292)..(292): n is a, c, g, or t
  modified_base (304)..(304): a, c, t, g, unknown or other
  misc_feature (304)..(304): n is a, c, g, or t
  modified_base (361)..(361): a, c, t, g, unknown or other
  misc_feature (361)..(361): n is a, c, g, or t
  modified_base (410)..(410): a, c, t, g, unknown or other
  misc_feature (410)..(410): n is a, c, g, or t
  modified_base (418)..(418): a, c, t, g, unknown or other
  misc_feature (418)..(418): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcccggacagtcggtcaccatctcctgcactggacccagcactgatgttgggcattataaccttgtctcctggtatcaaacaacgcccagacaaacgcccccanactctgatttangaatcagtaagcgccctcgagggttctagtcgcttctcctgcctcaagtctggcacncggcctcctgacaatctctggctcagctgacgagagctagatattacgngcatctanatagtagtagtagtggtctcttacgttacgtagggtttcggacggtacggaccgacggtcgtacgtaccgtacgtaacgtacgaacgacccgaacggccgtaccgtccccgtacgtactccg

SEQ ID NO: 350676 - DNA, 531 bp, Homo sapiens
  misc_feature: GZ8MTXP02J2ZPG.10.27.C05.1.454.CMB.2.raw
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (413)..(413): a, c, t, g, unknown or other
  misc_feature (413)..(413): n is a, c, g, or t
  modified_base (421)..(421): a, c, t, g, unknown or other
  misc_feature (421)..(421): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattataaccttgtctcctgtatcaacaacgcccagacaaacgccccacactcttgatttatgaagtcagtaagcgccctgaggggtttctagtcgcttcctctgcctcaagtctggcaacacgcctcctnacaatcnctggctccagctgacgacgaggctagaatattacngcagctanatagtgtagtagtggtctccgttacgttacgtaggtttccggacgggacggacgtacgtcgtacgtaccgtacgtacgtcgacgaccgacgtccgtccgtcccgtacgtc

SEQ ID NO: 350677 - DNA, 558 bp, Homo sapiens
  misc_feature: GZ8MTXP02GJPEV.10.27.C05.1.454.CMB.2.raw
  modified_base (293)..(293): a, c, t, g, unknown or other
  misc_feature (293)..(293): n is a, c, g, or t
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggacccagcactgatggttggctattataaccttgtctcctggtatcaacaacgcccagaccaaacgccccanactcttgatttatgaagtcagtaacgcggtccctgtaggggtttcagtcgtcttcctctcgcctcaagtctgcacncggcctccngacatctctggctcgagctgacgacgagctagaatattactgcagctctatatgtagagtggtctcgttcgtttcgtaacgggttttcggcgggtacggaccgtaggtccgtacgtacccgtacctaaacggtccgacgtacccgaaacggtccgtaccggtcccccgttcggtaccccg

SEQ ID NO: 350678 - DNA, 556 bp, Homo sapiens
  misc_feature: GZ8MTXP02JWKJM.10.27.C05.1.454.CMB.2.raw
  modified_base (321)..(321): a, c, t, g, unknown or other
  misc_feature (321)..(321): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacaacgcccagacaaacgccccacactcttgatttatgaagtcagtaagcggccctnaggggtttcagtcgcttcctctgcctcaagtctggcaacacggcctcctgacaatctctggctccaggctgacgacgagctagatattactgacagctcatatgtagattggtcgtccgttctttacgtaacggtttttcgggacgggtacggggtaccgtagggtcgtcggacccgttacgtaacgttccgacggtacccgaacggccgtcccggtcccccgtcggttaccccg

SEQ ID NO: 350679 - DNA, 513 bp, Homo sapiens
  misc_feature: GZ8MTXP02GPGLP.10.27.C05.1.454.CMB.2.raw
  modified_base (302)..(302): a, c, t, g, unknown or other
  misc_feature (302)..(302): n is a, c, g, or t
tcagcatagtagtgcacgaccggtgctcgatttagacgcgatcgaagggtttggggggtcacaagaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttcngatgtcagtgatcggtccctttgggactttccgtaatcgtcttctctcgcctcctaagtctggcaacacggccttccctgacctatctccggctccacgctgacggacgagctctattatactgcagctcatatacaccgagggcacgtctcgtagatacgttcggcggacggaccgtgctcgaccgtactacgtcacgccgaacggtccg

SEQ ID NO: 350680 - DNA, 548 bp, Homo sapiens
  misc_feature: GZ8MTXP02JHJHU.10.27.C05.1.454.CMB.2.raw
tcagcatagtagtgcacgaccggtgctcgatttagacgcgatcgaagggtttgggggggtcacaagaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaacagtacccaggcaaacgcccccaaactgatgatttatgatgtcagtaatcgaccctcgaggggtttctgatcgtcttcttgcccctcagtctgcaacacgcctcctgacctatctcgtgggctccagactgaggacgaggctgtattatactgcagctcacatacagcgcgaggtcgggttgggtcggttcggggacgggggaccacgacgtcggaccgtccgtaggtcacgacccgaacggcctccgcccccgtcggtccactccgtccgtccccgtcccc

SEQ ID NO: 350681 - DNA, 603 bp, Homo sapiens
  misc_feature: GZ8MTXP02FSHWP.10.27.C05.1.454.CMB.2.raw
  modified_base (292)..(292): a, c, t, g, unknown or other
  misc_feature (292)..(292): n is a, c, g, or t
  modified_base (306)..(306): a, c, t, g, unknown or other
  misc_feature (306)..(306): n is a, c, g, or t
  modified_base (369)..(369): a, c, t, g, unknown or other
  misc_feature (369)..(369): n is a, c, g, or t
  modified_base (377)..(377): a, c, t, g, unknown or other
  misc_feature (377)..(377): n is a, c, g, or t
  modified_base (437)..(437): a, c, t, g, unknown or other
  misc_feature (437)..(437): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcacccctcctcactcaggacacagggtcctgggccctgtctgccctgactcagcctgcctccgtgtctgggtctcctggacagtcggtcaccatctcctgcactcggacccagcactgatggtggctattataaccttgtctcctggtatcaacaacgcccagacaaacgccccanactcttgactttangaatcagtaacgccggcctcgtagggtttctagtcgtcttcctctcgcctcaagtctgcaacncgcctccngacatctcgtggctcagctgacgacgagctagaatattactgcagctacatagtgtaagnttgggtctccttacgtttacgttaacggggttttccgggacggggtacgggtaacccgagggtaccttacgggtaaccccgttaccgttaaacggttaaccgtaacccggaaccccgtaaacgggtccccgttacccggtaccccccggttcgggtttaacccccg

SEQ ID NO: 350682 - DNA, 571 bp, Homo sapiens
  misc_feature: GZ8MTXP02I7XZ1.10.27.C05.1.454.CMB.2.raw
  modified_base (299)..(299): a, c, t, g, unknown or other
  misc_feature (299)..(299): n is a, c, g, or t
  modified_base (363)..(363): a, c, t, g, unknown or other
  misc_feature (363)..(363): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctgtatcaacacgcccagaccaaagcccccacactctgatttangaagtcagtaagccgggccctcgtaggggtttctagtcgtcttctctgcctcaagtctgcaacncgcctcctgacatctctgggcctccgaggctgacgacgaggctagaatattactgcagctacatatagtagtatggtgccttactttcgtaacggttttcgggacgggtacggggacccgaggtccgtacggtaacccgttaccgtaaacggtccgaaccggacccccgaaacgggcccccgacccccgttaccggtcccttaacccg

SEQ ID NO: 350683 - DNA, 578 bp, Homo sapiens
  misc_feature: GZ8MTXP02JMI7I.10.27.C05.1.454.CMB.2.raw
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (421)..(421): a, c, t, g, unknown or other
  misc_feature (421)..(421): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacaacgcccagacaaacgccccanactcttgatttangaagtcagtaagcggccctcgaggggtttctagtcgcttcctctgcctccaagtctggcaacacggccctcctgactatctctggctccgaggctgacgacgagctagaagtacttacngtcagctacaatatagtagtatggtcgtcccttcgtttacgtaacgggttttccgggacgggtaacggggaccgtacgggcgttacggtacccgttaccgtaaacggtccgaacggtaccccgaaaggtcccgtccggtccccccgtcgttaccccg

SEQ ID NO: 350684 - DNA, 564 bp, Homo sapiens
  misc_feature: GZ8MTXP02I0OIX.10.27.C05.1.454.CMB.2.raw
  modified_base (300)..(300): a, c, t, g, unknown or other
  misc_feature (300)..(300): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctgtatcaacaacgcccagacaaacgccccacactctgatttangaagtcagtaagcggcctcgtaggggtttctagtcgtcttcctctcgcctacaagtctgctaacacggcctacctgacaatctctggcctcgagctgacgacgagctagaatattactgcagcttcatatagtagattggtctccgttctttacgtaaaggttttcggacgggtaacgggaccgtagggcctacggtaacccgtaccgttaaacgtccgaacggaccccgtaaacggcccgtccgtcccccgtacggttacccc

SEQ ID NO: 350685 - DNA, 574 bp, Homo sapiens
  misc_feature: GZ8MTXP02HB7Z3.10.27.C05.1.454.CMB.2.raw
  modified_base (417)..(417): a, c, t, g, unknown or other
  misc_feature (417)..(417): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaaacaacgcccagacaaacgcccccacactctgatttatgaatcagtaagcggccctcaggggtttctagtcgtcttcctctcgcctccaagtctggcaacacggcctcctgacatctctggctccagctgacgacgaggctagaatattacngcagtctactatatagtagtagtgtcgtccgttcgtttacggttaacgggtttaccgggacgggtacgggtaccgtacggtacgtaccggtaccggttaccgtaacgtaaccgaacgacccgtaacggtcccgtacccggtcccccgtaccgtaccg

SEQ ID NO: 350686 - DNA, 614 bp, Homo sapiens
  misc_feature: GZ8MTXP02I70L6.10.27.C05.1.454.CMB.2.raw
  modified_base (367)..(367): a, c, t, g, unknown or other
  misc_feature (367)..(367): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattataaccttgtctcctggtatcaacacgcccagacaaacgcccccacactctgatttatgaagtcagtaagccggccctcgtaggggtttctagtcgtcttcctctgcctccagtctggcaacncggcctcctgacaatctctggctcgagctgacgcgagctagatatactgtcagctacatatgtagagtggtcgtccttacgtttacgtaaacggggtttttccgggacggggtaacgggggtacccgtaaacgggtccgttaccggaccccggtttacccgttaaaacggttcccgtaaccgggacccccggtaaaacggggtcccgtttaccccggtaccccccccgggtttcggtttaacccccg

SEQ ID NO: 350687 - DNA, 551 bp, Homo sapiens
  misc_feature: GZ8MTXP02JY77V.10.27.C05.1.454.CMB.2.raw
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctgtatcaacaacgccagaccaaacgccccacactcttgatttatgaagtcagtaagcggccctgtaggggtttctagtcgcttcctctgcctccaagtctggcaacgacggcctcctgacaatctcgtcggctcgaggctgacgacgaggctagaattattacgtgcagctacatatgtagagtggtgtccttcgtttacgtaagggtttcggacgggacgggtaccaggtcgtacgacccgttacttaacgtcgacgaccccgacggtccgtcccggtcccccgtcggtaccc

SEQ ID NO: 350688 - DNA, 553 bp, Homo sapiens
  misc_feature: GZ8MTXP02JBLOQ.10.27.C05.1.454.CMB.2.raw
  modified_base (289)..(289): a, c, t, g, unknown or other
  misc_feature (289)..(289): n is a, c, g, or t
  modified_base (362)..(362): a, c, t, g, unknown or other
  misc_feature (362)..(362): n is a, c, g, or t
tcagcatagtagtgcacgaccggtgctcgatttagacgcgatcgaagggtttgggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataacccttgtctcctggtatcaacaacgcccagacaaagcccccanactcttgatttatgaagtcagtaagccggccctcgtaggggtttctagtcgtcttccgtctgcctccaagtcnggccaacacggcctccctgacaatctctggctcaggctgacgacgaggctagaatattactgcagtctcagtatgtagattggtcgtaccttgtttacgtaaaggggtttttcggcgggtacgggaccgtaggccttacggaacccgtcctaaagtccgacgtacccgaaggcctccggccccctggtccc

SEQ ID NO: 350689 - DNA, 538 bp, Homo sapiens
  misc_feature: GZ8MTXP02FVWX0.10.27.C05.1.454.CMB.2.raw
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacaacgcccagacaaacgcccccacactcttgatttatgaagtcagtaagcggccctcgtaggggtttctagtcgtcttcctctgcctccaagtctggcaacacggcctccctgacatctctggctcaggctgacgacgaggctgaatattactgcagctcatagtgtagagtggtcgccttcgtttacgtaagggttttcggacgggacgggaccgaggctcggaccgtcgtaaagtcgacgacccaacggccgtccgccccgtcggtaccc

SEQ ID NO: 350690 - DNA, 557 bp, Homo sapiens
  misc_feature: GZ8MTXP02GUNEV.10.27.C05.1.454.CMB.2.raw
  modified_base (289)..(289): a, c, t, g, unknown or other
  misc_feature (289)..(289): n is a, c, g, or t
  modified_base (424)..(424): a, c, t, g, unknown or other
  misc_feature (424)..(424): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacaacgcccagacaaagcccccanactcttgatttatgaagtcagtaagcggccctcaggggtttctagtcgtcttcctctcgcctaccaagtctgcaacacggtcctccctgacaatctcgtggcctcgacggctgacgacgagctagaatatactgnagctcatagtgtagatggtcgtccttcgtttacgtaaaggttttcgggcggtaacgggacgaacggtcgtacgtacccgtcgttaaaacgcgaacgtacccgaaacgggcctaccgtcccccgtacggtcccg

SEQ ID NO: 350691 - DNA, 564 bp, Homo sapiens
  misc_feature: GZ8MTXP02G3037.10.27.C05.1.454.CMB.2.raw
  modified_base (301)..(301): a, c, t, g, unknown or other
  misc_feature (301)..(301): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacaacgcccagacaaagccccacactcttgatttangaagtcaagtaagccggccctcgaggggtttctagtcgtcttcctctgcctcaagtctggcaacacggcctcctgacaatctctggctcacgctgacgacgagctagaatattaactgcagtctacatatgtagtagtggtacgtccttacgtttacgtaacggttttcggacgggtacgggaccgtacggtacgtacgtacccgttaccgtaacgtaaccgacgacccgtaacggccgtacccgtcccccgttcggtacccc

SEQ ID NO: 350692 - DNA, 571 bp, Homo sapiens
  misc_feature: GZ8MTXP02GD2Z5.10.27.C05.1.454.CMB.2.raw
  modified_base (267)..(267): a, c, t, g, unknown or other
  misc_feature (267)..(267): n is a, c, g, or t
  modified_base (284)..(284): a, c, t, g, unknown or other
  misc_feature (284)..(284): n is a, c, g, or t
  modified_base (297)..(297): a, c, t, g, unknown or other
  misc_feature (297)..(297): n is a, c, g, or t
  modified_base (368)..(368): a, c, t, g, unknown or other
  misc_feature (368)..(368): n is a, c, g, or t
  modified_base (419)..(419): a, c, t, g, unknown or other
  misc_feature (419)..(419): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataacttgtctctgtatcaacacnccagacaaacgccccanactcttgatttangaagtcagtaacgcggtccctcgtagggttctagtcgtcttctctcgcctcagtctgcaccacggcctccngacactctctcggctcgaggctgacgacggaggtctagaaattacttacgngtacagtctcaagttagtacgtagtacgtggtacgtccttcgtttacgtaagggttttccgggacggacggggtaccgacggtcgtacggtacccgttaccgtaacggtcgaccgacccgaacggtcccgtacccgtcccccgtcggtcccc

SEQ ID NO: 350693 - DNA, 613 bp, Homo sapiens
  misc_feature: GZ8MTXP02GM9F1.10.27.C05.1.454.CMB.2.raw
  modified_base (299)..(299): a, c, t, g, unknown or other
  misc_feature (299)..(299): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggctattataaccttgtctctgtatcaacacgccagaacaaacgccccacactctgtatttanagaagtcaagtaacgccggccctgtaggggtttctaggtccgtcttccctctcgccctactaagtctggaccaaccgaccggtccctccctagaactaaacttctacgtgggacctcgaacggctagaaccgacggaggctagaatattaactgaccagtctacaatagtagtagagttcgggtactccttacgtttacggtaacgggttttcgggacgggaacgggtacctagggacctaccggtaacccgtaccgttaacgggtaactacggaacccgtaacggtcctcccggtacccccgtcggttaaccc

SEQ ID NO: 350694 - DNA, 527 bp, Homo sapiens
  misc_feature: GZ8MTXP02FJV83.10.27.C05.1.454.CMB.2.raw
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccanactcttgatttangaagtcagtaagcgccctcgaggggtttcagtcgcttcctctgctcaagtctggcaacacgcctccctgacaatctctggctccaggctgacgacgaggctgaaatattactgcagctcatatgtagatggtgccttcgtttcaagggttttcggacggtagggaccaggcctcgaccgtccctaaagtcgacgcccaacggccttacgcccccgtcggtaccc

SEQ ID NO: 350695 - DNA, 565 bp, Homo sapiens
  misc_feature: GZ8MTXP02I0PAA.10.27.C05.1.454.CMB.2.raw
  modified_base (421)..(421): a, c, t, g, unknown or other
  misc_feature (421)..(421): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacacgcccagacaaacgcccccacactcttgatttatgaagtcagtaagccggcctcaggggtttctagtcgtcttcctctcgtcctaccaagtctggccaacacggccctcctgacaatctctggctcaggctgacgacgaggctagatattacngcagctcatatagtagtatggtcgtccttacgtttacgtaacggttttcgggcgggttacgggaccgacgggtacgtacggtacccgttccgtaacgttccgaacgacccgtaaacggtcccgtccgcccccgtacggttcccc

SEQ ID NO: 350696 - DNA, 600 bp, Homo sapiens
  misc_feature: GZ8MTXP02HMQHV.10.27.C05.1.454.CMB.2.raw
  modified_base (290)..(290): a, c, t, g, unknown or other
  misc_feature (290)..(290): n is a, c, g, or t
  modified_base (417)..(417): a, c, t, g, unknown or other
  misc_feature (417)..(417): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattataaccttgtctcctggtatcaacacgcccagacaaacgcccccanactcttgatttatgaagtcagtaacgccggccctgtaggggtttctagtcgtcttcctctcgtcctaccaagtctggccaaacgaccggccctccctgacaatctcgtggcctcaggctgacgacgngctagaatattactgacagtctacaatatgtagagtggtctcttacgtttacgtaaacgggttttcgggacggtacgggtaaccgtagggacgttacggacccgttaccgtaaaacggttaaccgacggtaaccccgtaacgggtcccgtacccggtccccccggtttaacggtttacccccg

SEQ ID NO: 350697 - DNA, 610 bp, Homo sapiens
  misc_feature: GZ8MTXP02GVYV6.10.27.C05.1.454.CMB.2.raw
  modified_base (285)..(285): a, c, t, g, unknown or other
  misc_feature (285)..(285): n is a, c, g, or t
  modified_base (298)..(298): a, c, t, g, unknown or other
  misc_feature (298)..(298): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgtcaccatctcctgcactggacccagcactgatgttggctattataaccttgtctcctgtatcaacacgccagacaaacgccccanactctgtatttangaatcagtaagccggccctgtaggggtttctagtcgtcttcctctcgcctaccgtaagtctaggccaaacgaccggtccctacccgtagaacctaaacttcctcgtcgggtcctccgacggctcgggacgacggaggactagtaaattattacgtgactacgtcctacgtaattagtagtaagtagttggtacgttccttcgtttacgtaacgggttttcgggacgggtagggaccgaggtacctacggtacccgtaccgtaacgtccgtaacgacccgaacggtcctacccggtcccccgtacggttcccc

SEQ ID NO: 350698 - DNA, 596 bp, Homo sapiens
  misc_feature: GZ8MTXP02JIQSI.10.27.C05.1.454.CMB.2.raw
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
  modified_base (438)..(438): a, c, t, g, unknown or other
  misc_feature (438)..(438): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcacgtggacccagcactgatgttggcattataaccttgtctcctggtatcaacaacgcccagacaaacgccccanactctgatttangaagtcagtagcggcctcgagggtttcagtcgacttcctctgcctccaagtctggctaacncggtcctccgtgactaatctcgtcggtctaccgagcgtagacgacgaggtctagaacttatactcgtcacgtacnctatatgtaagtagtggtcgtacttcgtttacgtaacgggttttcggacgggttagggaaccgacgggtacgttacgtaacccgttaccgttaaacggttaaccgtaaccggacccgaacggtacccgtacccggtacccccgttacgggtttccccg

SEQ ID NO: 350699 - DNA, 568 bp, Homo sapiens
  misc_feature: GZ8MTXP02F2AAJ.10.27.C05.1.454.CMB.2.raw
  modified_base (300)..(300): a, c, t, g, unknown or other
  misc_feature (300)..(300): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctgtatcaacaacgcccagacaaagccccacactctgatttatnaagtcagtaagcggccctcgtaggggtttctagtcgtcttccctctcgctccaagtctgcaacacggcctccctgacaatctctggctcagctgacgacgaggctgaatattaactgtcagctcattatgtagagtggttcgccttcgtttacgtaagggtttttaccgggacggggtacggggaccgtaagggcttacgggtaacccgttccgtaaacggtcgaacggtccccgaaacggccgttaccgcccccgttccggtacccg

SEQ ID NO: 350700 - DNA, 651 bp, Homo sapiens
  misc_feature: GZ8MTXP02JH51Y.10.27.C05.1.454.CMB.2.raw
  modified_base (296)..(296): a, c, t, g, unknown or other
  misc_feature (296)..(296): n is a, c, g, or t
  modified_base (463)..(463): a, c, t, g, unknown or other
  misc_feature (463)..(463): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggcattataacttgtctctgtatcaacacgccagacaaacgccccacactctgtatttangaagtcagtaacgccggcctgtacgggtttctagtcgtcttcctctcgtcctactaacgtctcggccaaacgaccggccctacccgtagaacctaaactccgtcgtcgggcccttcccgaaggtcctaggaaccgacggaggtcctaaggtaaattacgtttaacgngacacgtcctatagttaataggtaagtaagttcgggttactcccgtttacgtttacggttaaacggggttttcgggaccggggtaacgggaccgtaacgggtccgtacggtaacccgttacgtaaacggtccgaaccggtaccccgtaaacgggtcccgtacccggtacccccggttcggtaaccccg

SEQ ID NO: 350701 - DNA, 558 bp, Homo sapiens
  misc_feature: GZ8MTXP02G5F73.10.27.C05.1.454.CMB.2.raw
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcggtcaccatctcctgcactggacccagcactgatgttggcattataaccttgtctcctggtatcaacaacgccagacaaacgccccacactctgattatgaagtcagtaagcgcctcgtaggggtttctagtcgtcttcctctcgcctcaagtctggcaacacggcctccctgaacactctcgtcggctccgaggctgacgacgaggctagatacttactgcagtctacatagtcgtagtatggtcgtccttacgtttcgtaacgggttttcgggcgggtagggaccgtaggcgtacgtaccgtccgtaaacgtccgaacggacccgaacggtccgtacccgtcccccgtcggtacccc

SEQ ID NO: 350702 - DNA, 530 bp, Homo sapiens
  misc_feature: GZ8MTXP02FTJ3B.10.27.C05.1.454.CMB.2.raw
  modified_base (301)..(301): a, c, t, g, unknown or other
  misc_feature (301)..(301): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagccccacactcttgatttangaagtcagtaagcggcctcaggggtttctagtcgcttcctctgcctcaagtctggcaacacggcctaccctgacaatctctggctcgagctgacgacgaggctagaactattactgcagctacatatgtagatggtgccttcgtttacgtaagggttttcggcgggacgggtaccgagggctcggaccgtcctaaagtcacgacccaaggcctccgccccgtcggtccc

SEQ ID NO: 350703 - DNA, 582 bp, Homo sapiens
  misc_feature: GZ8MTXP02GRUGQ.10.27.C05.1.454.CMB.2.raw
  modified_base (297)..(297): a, c, t, g, unknown or other
  misc_feature (297)..(297): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataacttgtctctgtatcaacacgcccagacaaacgccccacactctgatttangaagtcagtaacgccggcctcgtaggggtttctagtcgtcttcctctcgcctccaagtctggcaacgaccggccctccctgaaccaagtcctcgtcgggctccgaggctgacgacgagctagaatattactgacagtctactattatagtagtagtggtacgtccttacgtttacgtacggttttcgggacgggtacgggaccgtagggtcctcggacccgttaccgtaacgtccgaaccggacccgtaacggtccgtacccggtccccccgttacggtaccccg

SEQ ID NO: 350704 - DNA, 617 bp, Homo sapiens
  misc_feature: GZ8MTXP02IE2WA.10.27.C05.1.454.CMB.2.raw
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcacccctcctcactcaggacacagggtcctgggccctgtctgccctgactcagcctgcctccgtgtctgggtctcctggacaggtcggtcaccatctcctgcacgtcggacccagcactgatggttggactattactaaccttgtctcctggtatacaacaacgcccaagacaaaccgccccanactcttagtatttanagaagtacaaggtaacgccggtcccttaggtacgggtttactagtccgtctttcctctcgcctcaagtctggccaacgacgcctcctagacacttcgctggcctaccgagctcgacgtacgagactagtactatactcgactacgtctactagtattagtagtacgtgttcgtcccgtttacgtttacggtaaacgggttttccgggacgggtaacgggaaccgtacggtccgtacgtacccgttacgtaacgtccgacggaacccgtacgtaccgtcccgtaccccggttacggtaccccg

SEQ ID NO: 350705 - DNA, 554 bp, Homo sapiens
  misc_feature: GZ8MTXP02G5YDC.10.27.C05.1.454.CMB.2.raw
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (381)..(381): a, c, t, g, unknown or other
  misc_feature (381)..(381): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcggtcaccatctcctgcactggacccagcactgatgttggctattataaccttgtctcctggtatcaacaacgcccagacaaacgccccanactcttgatttangaatcagtaagcggcctgacgggtttctagtcgtcttcctctcgcctcaagtctggcaacacggcctcctgacaatctnggcctcgagctgacgacgagctagaatactactgcagctacatagtagtagagttgtcgtctttacgtttacggtaacggttttcgggacgggtagggaccgacgggtctacggtaccgtaccgtaagtccgaacgtacccgaacggcctacccgtcccccgttggtaccccg

SEQ ID NO: 350706 - DNA, 604 bp, Homo sapiens
  misc_feature: GZ8MTXP02I5O2D.10.27.C05.1.454.CMB.2.raw
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattactaaccttgtctcctgtatcaacaacgccagacaaacgccccacactctgatttatgaagtcagtaacgccggccctcgtagggtttctagtcgtcttcctctcgcctaccaagtcctggccaacacggtcctcccgtgacaaactctacgtgggcctccgaggctgacgacgaggctagaaatattaactgacagctcatatagtagagttggtacgtcctttacgtttacgtaagggtttttcgggacgggtacggggtaccgtagggtaccgtacggtaacccggttccgtaaacggttccgaacggaccccgtaaaccgggccgttaccccggtcccccgttaccgggttaccccg

SEQ ID NO: 350707 - DNA, 662 bp, Homo sapiens
  misc_feature: GZ8MTXP02G2539.10.27.C05.1.454.CMB.2.raw
  modified_base (270)..(270): a, c, t, g, unknown or other
  misc_feature (270)..(270): n is a, c, g, or t
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
  modified_base (301)..(301): a, c, t, g, unknown or other
  misc_feature (301)..(301): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatggttggctattataacttgtctctggtatcaacacnccagacaaacnccccanactctagtatttanagaagtcaagtaacgccggccctcgtacggggtttctagtcgtcttcctctcgtcctacctaagtcctcggacctaaccgaccggtcccttaccctacgaacctaaacttcccgtccgtcgggtcccttaccgacggccgtacggaaccgaccggtacggtccgtaaggtaaacttaacgtttaccgtaggacctaacggtcctaaccgtaattagttagttaagtaacgttgggttacgtccgtttacgtttacggttaacggttttacgggaccgggttacgggaccgtaacggtccgtacgtacccgtacgtacgtaacgacgacccgtacgtccgtacccgtccccgtcggtacccg

SEQ ID NO: 350708 - DNA, 551 bp, Homo sapiens
  misc_feature: GZ8MTXP02FS6E0.10.27.C05.1.454.CMB.2.raw
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
  modified_base (411)..(411): a, c, t, g, unknown or other
  misc_feature (411)..(411): n is a, c, g, or t
  modified_base (424)..(424): a, c, t, g, unknown or other
  misc_feature (424)..(424): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacacgcccagacaaagcccccanactcttgatttngaagtcagtaagcggccctgaggggtttcagtcgcttcctctcgctccagtcctggccaacgacggccctcctgacatctcgtggctcgaggctgacgacgaggctgaatnttactgacagctnatagtgtagatggtactccttacgtttcgtaagggtttcggacgggtacgggacctagggtcctcggaacccgttcgtaaaagtccgaacgtaccccgaagggcccttcggtcccccgtcggtaccc

SEQ ID NO: 350709 - DNA, 621 bp, Homo sapiens
  misc_feature: GZ8MTXP02GPR8J.10.27.C05.1.454.CMB.2.raw
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgtcaccatctcctgcactggacccagcactgatgttggctattataaccttgtctcctgtatcaacacgcccagacaacgccccanactctgatttangtaatcagtaacgcggcctcgtagggttctagtcgtcttcctctgccctacaagtctggcaacacggcctccctagactaatctacgtcgggtcctccgaggctagaccgacggacggacttagtaaacgttattacgtcgacacgtcctactaagttaagttagtaaaggtgttcgggttacgtacctttacgttttaccggttaaacgggtttttccggggacggggtaacggggtaccaacgggtccgtaccggtaacccggttaccgtaaacgtccgaccggtacccgaaggtcccaccggtcccccgtacggttaccc
